US009803009B2

(12) United States Patent
Hsieh et al.

(10) Patent No.: US 9,803,009 B2
(45) Date of Patent: *Oct. 31, 2017

(54) IMMUNOBINDERS DIRECTED AGAINST TNF

(71) Applicant: AbbVie Inc., North Chicago, IL (US)

(72) Inventors: Chung-Ming Hsieh, Newton, MA (US); Lorenzo Benatuil, Northborough, MA (US); Yuliya Kutskova, Northborough, MA (US); John Memmott, Framingham, MA (US); Jennifer Perez, Worcester, MA (US); Suju Zhong, Shrewsbury, MA (US); Carrie Goodreau, Ludlow, MA (US); Anca Clabbers, Rutland, MA (US)

(73) Assignee: AbbVie Inc., North Chicago, IL (US)

(*) Notice: Subject to any disclaimer, the term of this patent is extended or adjusted under 35 U.S.C. 154(b) by 675 days.

This patent is subject to a terminal disclaimer.

(21) Appl. No.: 13/659,658

(22) Filed: Oct. 24, 2012

(65) Prior Publication Data

US 2013/0164256 A1   Jun. 27, 2013

Related U.S. Application Data

(60) Provisional application No. 61/550,587, filed on Oct. 24, 2011.

(51) Int. Cl.
| | | |
|---|---|---|
| *A61K 39/395* | (2006.01) | |
| *A61K 39/00* | (2006.01) | |
| *C12P 21/08* | (2006.01) | |
| *C07K 16/00* | (2006.01) | |
| *C07K 16/24* | (2006.01) | |
| *C07K 16/46* | (2006.01) | |
| *G01N 33/68* | (2006.01) | |
| *A61K 47/48* | (2006.01) | |
| *A61K 45/06* | (2006.01) | |

(52) U.S. Cl.
CPC ........ *C07K 16/241* (2013.01); *A61K 39/3955* (2013.01); *A61K 45/06* (2013.01); *A61K 47/48546* (2013.01); *C07K 16/464* (2013.01); *G01N 33/6863* (2013.01); *C07K 2317/21* (2013.01); *C07K 2317/24* (2013.01); *C07K 2317/33* (2013.01); *C07K 2317/565* (2013.01); *C07K 2317/567* (2013.01); *C07K 2317/622* (2013.01); *C07K 2317/64* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 5,231,024 A | 7/1993 | Moeller et al. | |
| 5,624,821 A | 4/1997 | Winter et al. | |
| 5,648,260 A | 7/1997 | Winter et al. | |
| 7,612,181 B2 | 11/2009 | Wu et al. | |
| 8,735,546 B2 | 5/2014 | Ghayur et al. | |
| 8,779,101 B2 | 7/2014 | Hsieh et al. | |
| 8,835,610 B2 | 9/2014 | Hsieh et al. | |
| 8,877,194 B2 | 11/2014 | Hsieh et al. | |
| 8,999,331 B2 | 4/2015 | Hsieh et al. | |
| 9,481,735 B2 | 11/2016 | Hsieh et al. | |
| 9,481,736 B2 | 11/2016 | Hsieh et al. | |
| 9,493,560 B2 | 11/2016 | Ghayur et al. | |
| 2006/0024308 A1 | 2/2006 | Crea | |
| 2009/0239259 A1 | 9/2009 | Hsieh | |
| 2009/0311253 A1 | 12/2009 | Ghayur et al. | |
| 2010/0266531 A1 | 10/2010 | Hsieh et al. | |
| 2011/0250130 A1 | 10/2011 | Benatuil et al. | |
| 2012/0034160 A1 | 2/2012 | Ghayur et al. | |
| 2012/0230911 A1 | 9/2012 | Hsieh et al. | |
| 2013/0171096 A1 | 7/2013 | Hsieh et al. | |
| 2014/0079705 A1 | 3/2014 | Hsieh et al. | |
| 2014/0161804 A1 | 6/2014 | Perez et al. | |
| 2014/0170152 A1 | 6/2014 | Hsieh et al. | |
| 2014/0219912 A1 | 8/2014 | Ghayur et al. | |
| 2014/0220019 A1 | 8/2014 | Ghayur et al. | |
| 2014/0234208 A1 | 8/2014 | Ghayur et al. | |
| 2014/0271457 A1 | 9/2014 | Ghayur et al. | |
| 2014/0335564 A1 | 11/2014 | Hsieh et al. | |
| 2014/0343267 A1 | 11/2014 | Hsieh et al. | |
| 2014/0348834 A1 | 11/2014 | Hsieh et al. | |

(Continued)

FOREIGN PATENT DOCUMENTS

| | | |
|---|---|---|
| WO | 9729131 A1 | 8/1997 |
| WO | 2004050683 A2 | 6/2004 |

(Continued)

OTHER PUBLICATIONS

Sundberg. Structural basis of antibody-antigen interactions. Methods in Molecular Biology, 524:23-36, 2009.*
Paul. Fv structure and diversity in three dimension. Fundamental Immunology, 3rd Edition, Raven Press, New York, Chapter 8, pp. 292-295, 1993.*
MacCallum et al. Antibody interactions: contact analysis and binding site topography. Journal of Molecular Biology, 262:732-745, 1996.*
Casset et al. A peptide mimetic of an anti-CD4 monoclonal antibody by rational design. Biochemical and Biophysical Research Communications, 307:198-205, 2003.*
Rudikoff et al. Single amino acid substitution altering antigen-binding specificity. Proceeding of the National Academy of Sciences, 79(6):1979-1983, Mar. 1982.*

(Continued)

*Primary Examiner* — Vanessa L Ford
*Assistant Examiner* — Sandra Dillahunt
(74) *Attorney, Agent, or Firm* — Sterne, Kessler, Goldstein & Fox P.L.L.C.

(57) ABSTRACT

Isolated binding proteins, e.g., antibodies or antigen binding portions thereof, which bind to tumor necrosis factor-alpha (TNF-α), e.g., human TNF-α, and related antibody-based compositions and molecules are disclosed. Also disclosed are pharmaceutical compositions comprising the antibodies, as well as therapeutic and diagnostic methods for using the antibodies.

12 Claims, No Drawings

(56) References Cited

U.S. PATENT DOCUMENTS

| | | |
|---|---|---|
| 2014/0348856 A1 | 11/2014 | Hsieh et al. |
| 2014/0356909 A1 | 12/2014 | Hsieh et al. |

FOREIGN PATENT DOCUMENTS

| | | |
|---|---|---|
| WO | WO-2004/063335 A2 | 7/2004 |
| WO | 2005014650 A1 | 2/2005 |
| WO | 2006119107 A2 | 11/2006 |
| WO | 2008061013 A2 | 5/2008 |
| WO | 2008115732 A2 | 9/2008 |
| WO | 2008133722 A2 | 11/2008 |
| WO | 2009047356 A1 | 4/2009 |
| WO | 2009091912 A2 | 7/2009 |
| WO | 2009149189 A2 | 12/2009 |
| WO | 2010102251 A2 | 9/2010 |
| WO | 2011059755 A2 | 5/2011 |
| WO | 2011127141 A1 | 10/2011 |
| WO | 2012018790 A2 | 2/2012 |
| WO | WO 2012/078878 A2 | 6/2012 |

OTHER PUBLICATIONS

Colman. Effects of amino acid sequence changes on antibody-antigen interactions. Research in Immunology, 145:33-36, 1994.*
Holler, E., et al., "Modulation of Acute Graft-Versus-Host Disease After Allogeneic Bone Marrow Transplantation by Tumor Necrosis Factor α (TNFα) Release in the Course of Pretransplant Conditioning: Role of Conditioning Regimens and Prophylactic Application of a Monoclonal Antibody Neutralizing Human TNFα (MAK 195F)," *Blood* 86(3):890-899, The American Society of Hematology, United States (1995).
Thie, H., et al., "Phage Display Derived Therapeutic Antibodies," *current Pharmaceutical Biotechnology* 9:439-445, Bentham Science Publishers Ltd., Netherlands (2008).
Chen, W., et al., "Improved Isolation of Anti-rhTNF-α scFvs from Phage Display Library by Bioinformatics," *Mol Biotechnol* 43:20-28, Humana Press, Inc., United States (2009).
Co-pending U.S. Appl. No. 15/270,945, inventors Ghayur, T., et al., filed Sep. 20, 2016 (Not Published).
Co-pending U.S. Appl. No. 15/219,584, inventors Ghayur, T., et al., filed Jul. 26, 2016 (Not Published).
Lindner, H., et al., "Peripheral Blood Mononuclear Cells Induce Programmed Cell Death in Human Endothelial Cells and May Prevent Repair: Role of Cytokines," *Blood* 89:1931-1938, American Society of Hematology, United States (1997).
Moeller A., et al.,"Monoclonal Antibodies to Human Rumor Necrosis Factor Alpha: in Vitro and in Vivo Application," *Cytokine* 2:162-169, Academic Press Ltd., United States (1990).
Non-Final Office Action mailed Oct. 9, 2015, in U.S. Appl. No. 14/073,479, inventors Hsieh C., et al., filed Nov. 6, 2013.
Final Office Action mailed May 16, 2016, in U.S. Appl. No. 14/073,479, inventors Hsieh C., et al., filed Nov. 6, 2013.
Non-Final Office Action mailed Apr. 16, 2015, in U.S. Appl. No. 13/659,666, inventors Perez J., et al., filed Oct. 24, 2012.
Final Office Action mailed Aug. 25, 2015, in U.S. Appl. No. 13/659,666, inventors Perez J., et al., filed Oct. 24, 2012.
Non-Final Office Action mailed Jun. 10, 2016, in U.S. Appl. No. 13/659,666, inventors Perez J., et al., filed Oct. 24, 2012.
Non-Final Office Action mailed Feb. 14, 2014, in U.S. Appl. No. 13/659,647, inventors Hsieh C., et al., filed Oct. 24, 2012.
Final Office Action mailed Jul. 29, 2014, in U.S. Appl. No. 13/659,647, inventors Hsieh C., et al., filed Oct. 24, 2012.
Office Communication mailed Feb. 5, 2014, in U.S. Appl. No. 13/314,878, inventors Hsieh C., et al., filed Dec. 8, 2011.
International Search Report and Written Opinion in related application PCT/US2012/061690 mailed Mar. 15, 2013, 20 pages.
International Search Report and Written Opinion in related application PCT/US2012/0061666 mailed Mar. 15, 2013, 22 pages.
Lewiecki, Michael: "Sclerostin monoclonal antibody therapy with AMG 785: a potential treatment for osteoporosis", Expert Opinion on Biological Therapy, Informa Healthcare, UK, vol. 11, No. 1, pp. 117-127 (2011).
International Search Report and Written Opinion in related PCT application PCT/US2012/061686, mailed on Mar. 15, 2013, 24 pages.
Nakanishi, et al., Interleukin-18 regulates Both Th1 and Th2 Responses, Ann. Rev. Immunol. 19: 423-74, (2001).
Arndt and Krauss, Bispecific Diabodies for Cancer Therapy, Methods Mol. Biol. 207: 305-21, (2003).
Durocher et al., "High-level and high-throughput recombinant protein production by transient transfection of suspension-growing human 293-EBNA1 cells", Nucleic Acids Res. 30(2), (2002).
Mizushima and Nagata, "pEF-BOS, a powerful mammalian expression vector", Nucleic Acids Res. 18(17), (1990).
Holliger et al., Diabodies: Small bivalent and bispecific antibody fragments, Proc. Natl. Acad. Sci. USA 90:6444-6448; (1993).
Poljak, et al., Production and structure of diabodies, Structure 2:1121-1123, (1994).
Urlaub and Chasin, "Isolation of Chinese hamster cell mutants deficient in dihydrofolate reductase activity," Proc. Natl. Acad. Sci. USA 77:4216-4220, (1980).
Kaufman and Sharp, Amplfication and Expression of Sequences Cotransfected with a Modular Dihydrofolate Reductase Complementary DNA Gene, Mol. Biol. 159:601-621, (1982).
McDonnell, et al., TNF Antagonism, Progress Respir. Res., 31:247-250, (2001).
Harriman G, et al., Summary of clinical trials in rheumatoid arthritis using infliximab, an anti-TNFalpha treatment, Ann. Rheum. Dis., 58 Suppl 1:I61-4, (1999).
Peng, Experimental Use of Murine Lupus Models, Methods Mol. Med., 102:227-72, (2004).
Bossers, et al., Analysis of Gene Expression in Parkinson's Disease: Possible Involvement of Neurotrophic Support and Axon Guidance in Dopaminergic Cell Death, Brain Pathol., 19: 91-107, (2009).
McGee et al., "The Nogo-66 receptor: focusing myelin inhibition of axon regeneration", Trends Neurosci., 26:193, (2003).

* cited by examiner

IMMUNOBINDERS DIRECTED AGAINST TNF

CROSS-REFERENCE TO RELATED APPLICATIONS

This application claims priority to U.S. Provisional Application Ser. No. 61/550,587, filed Oct. 24, 2011, which is incorporated herein by reference in its entirety.

SEQUENCE LISTING

The instant application contains a Sequence Listing which has been submitted electronically in ASCII format and is hereby incorporated by reference in its entirety. Said ASCII copy, created on Jul. 3, 2014, is named 532365_BBI-387_Sequence_Listing.txt and is approximately 1,223,428 bytes in size. This sequence listing replaces a previous sequence listing in ASCII format that was submitted Feb. 27, 2013, and which was also incorporated by reference in its entirety.

BACKGROUND OF THE INVENTION

Field of the Invention

TNF-α binding proteins and their uses in the prevention and/or treatment of acute and chronic immunological diseases are provided.

Background of the Invention

There is a need in the art for improved binding proteins capable of binding TNF-α (also referred to as tumor necrosis factor, tumor necrosis factor-alpha, tumor necrosis factor-α, TNF, and cachectin). Provided are a novel family of binding proteins, CDR grafted binding proteins, humanized binding proteins, and fragments thereof, capable of binding TNF-α with high affinity and neutralizing TNF-α.

BRIEF SUMMARY OF THE INVENTION

TNF-α binding proteins, or antigen-binding portions thereof, that bind TNF-α are provided. In an embodiment, the antigen binding domain comprises the VH region chosen from any one of SEQ ID NOs: 22, 24, 26, 28, 30, 32, 34-58, 74-83, 94-266, 478-486, 496-675, 738-762, 778-956, 1053-1062, 1073, 1075, and 1077, or one, two, or three CDRs therefrom. In another embodiment, the antigen binding domain comprises the VL region chosen from any one of SEQ ID NOs: 23, 25, 27, 29, 31, 33, 59-73, 84-93, 267-477, 487-495, 676-737, 763-777, 957-1052, 1063-1072, 1074, 1076, and 1078, or one, two, or three CDRs therefrom. In a particular embodiment, the antigen binding domain comprises a VH region and a VL region, for example, wherein the VH region comprises SEQ ID NOs: 22, 24, 26, 28, 30, 32, 34-58, 74-83, 94-266, 478-486, 496-675, 738-762, 778-956, 1053-1062, 1073, 1075, and 1077, or one, two, or three CDRs therefrom, and the VL region comprises SEQ ID NOs: 23, 25, 27, 29, 31, 33, 59-73, 84-93, 267-477, 487-495, 676-737, 763-777, 957-1052, 1063-1072, 1074, 1076, and 1078, or one, two, or three CDRs therefrom.

In an embodiment, the binding protein binds TNF-α. In another embodiment, the binding protein modulates a biological function of TNF-α. In another embodiment, the binding protein neutralizes TNF-α. In yet another embodiment, the binding protein diminishes the ability of TNF-α to bind to its receptor, for example, the binding protein diminishes the ability of pro-human TNF-α, mature-human TNF-α, or truncated-human TNF-α to bind to its receptor. In yet another embodiment, the binding protein reduces one or more TNF-α biological activities selected from: TNF-dependent cytokine production; TNF-dependent cell killing; TNF-dependent inflammation; TNF-dependent bone erosion; and TNF-dependent cartilage damage.

In an embodiment, the binding protein has an on rate constant ($K_{on}$) selected from: at least about $10^2$ $M^{-1}s^{-1}$; at least about $10^3$ $M^{-1}s^{-1}$; at least about $10^4$ $M^{-1}s^{-1}$; at least about $10^5$ $M^{-1}s^{-1}$; and at least about $10^6$ $M^{-1}s^{-1}$; as measured by surface plasmon resonance. In another embodiment, the binding protein has an off rate constant ($K_{off}$) selected from: at most about $10^{-3}$ $s^{-1}$; at most about $10^{-4}$ $s^{-1}$; at most about $10^{-5}$ $s^{-1}$; and at most about $10^{-6}$ $s^{-1}$, as measured by surface plasmon resonance. In yet another embodiment, the binding protein has a dissociation constant ($K_D$) selected from: at most about $10^{-7}$ M; at most about $10^{-8}$ M; at most about $10^{-9}$ M; at most about $10^{-10}$ M; at most about $10^{-11}$ M; at most about $10^{-12}$ M; and at most $10^{-13}$ M.

In another aspect, a method for treating a mammal is provided comprising administering to the mammal an effective amount of the pharmaceutical composition disclosed herein. In another embodiment, a method for reducing human TNF-α activity is provided, the method comprising: contacting human TNF-α with the binding protein disclosed herein such that human TNF-α activity is reduced. In another embodiment, provided is a method for reducing human TNF-α activity in a human subject suffering from a disorder in which TNF-α activity is detrimental, the method comprising administering to the human subject the binding protein disclosed herein such that human TNF-α activity in the human subject is reduced. In another embodiment, provided is a method for treating a subject for a disease or a disorder in which TNF-α activity is detrimental, the method comprising administering to the subject the binding protein disclosed herein such that treatment is achieved.

In one embodiment, the method treats diseases involving immune and inflammatory elements, such as autoimmune diseases, particularly those associated with inflammation, including Crohn's disease, psoriasis (including plaque psoriasis), arthritis (including rheumatoid arthritis, psoratic arthritis, osteoarthritis, or juvenile idiopathic arthritis), multiple sclerosis, and ankylosing spondylitis. Therefore, the binding proteins herein may be used to treat these disorders.

DETAILED DESCRIPTION OF THE INVENTION

Provided are TNF-α binding proteins, or antigen-binding portions thereof, that bind TNF-α, pharmaceutical compositions thereof, as well as nucleic acids, recombinant expression vectors and host cells for making such binding proteins and fragments. Also provided are methods of using the binding proteins disclosed herein to detect human TNF-α, to inhibit human TNF-α either in vitro or in vivo, and to regulate gene expression or TNF-α related functions.

Unless otherwise defined herein, scientific and technical terms used in connection with the present disclosure shall have the meanings that are commonly understood by those of ordinary skill in the art. The meaning and scope of the terms should be clear, however, in the event of any latent ambiguity, definitions provided herein take precedent over any dictionary or extrinsic definition. Further, unless otherwise required by context, singular terms shall include pluralities and plural terms shall include the singular. In this application, the use of "or" means "and/or", unless stated otherwise. Furthermore, the use of the term "including", as well as other forms of the term, such as "includes" and "included", is not limiting. Also, terms such as "element" or "component" encompass both elements and components comprising one unit and elements and components that comprise more than one subunit unless specifically stated otherwise.

Generally, nomenclatures used in connection with, and techniques of, cell and tissue culture, pathology, oncology, molecular biology, immunology, microbiology, genetics and protein and nucleic acid chemistry and hybridization described herein are those well known and commonly used in the art. The methods and techniques of the present disclosure are generally performed according to conventional methods well known in the art and as described in various general and more specific references that are cited and discussed throughout the present specification unless otherwise indicated. See, e.g., Sambrook et al. Molecular Cloning: A Laboratory Manual (2d ed., Cold Spring Harbor Laboratory Press, Cold Spring Harbor, N.Y. (1989)). Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

The term "human TNF-α" (abbreviated herein as hTNF-α) includes a trimeric cytokine protein. The term includes a homotrimeric protein comprising three 17.5 kD TNF-α proteins. The homotrimeric protein is referred to as a "TNF-α protein". The term human "TNF-α" is intended to include recombinant human TNF-α (rhTNF-α), which can be prepared by standard recombinant expression methods. The sequence of human TNF-α is shown in Table 1.

TABLE 1

Sequence of Human TNF-α

| Protein | Sequence Identifier | Sequence 123456789012345678901234567890012 |
|---|---|---|
| Human TNF-α | SEQ ID NO.: 1 | VRSSSRTPSDKPVAHVVANPQAEGQLQWLNDR ANALLANGVELRDNQLVVPSEGLYLIYSQVLF KGQGCPSTHVLLTHTISRIAVSYQTKVNLLSA IKSPCQRETPEGAEAKPWYEPIYLGGVFQLEK GDRLSAEINRPDYLDFAESGQVYFGIIAL |

The term "antibody", broadly refers to any immunoglobulin (Ig) molecule, or antigen binding portion thereof, comprised of four polypeptide chains, two heavy (H) chains and two light (L) chains, or any functional fragment, mutant, variant, or derivation thereof, which retains the essential epitope binding features of an Ig molecule. Such mutant, variant, or derivative antibody formats are known in the art.

In a full-length antibody, each heavy chain is comprised of a heavy chain variable region (abbreviated herein as HCVR or VH) and a heavy chain constant region. The heavy chain constant region is comprised of three domains, CH1, CH2 and CH3. Each light chain is comprised of a light chain variable region (abbreviated herein as LCVR or VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. Immunoglobulin molecules can be of any type (e.g., IgG, IgE, IgM, IgD, IgA and IgY), class (e.g., IgG 1, IgG2, IgG 3, IgG4, IgA1 and IgA2) or subclass.

The term "antigen-binding portion" or "antigen-binding region" of a binding protein (or simply "binding protein portion"), refers to one or more fragments of a binding protein that retain the ability to specifically bind to an antigen (e.g., hTNF-α). The antigen-binding function of a binding protein can be performed by fragments of a full-length binding protein. Such binding protein embodiments may also have bispecific, dual specific, or multi-specific formats; specifically binding to two or more different antigens. Examples of binding fragments encompassed within the term "antigen-binding portion" of a binding protein include (i) a Fab fragment, a monovalent fragment consisting of the VL, VH, CL and CH1 domains; (ii) a F(ab')₂ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al. (1989) Nature 341:544-546, Winter et al., PCT publication WO 90/05144 A1), which comprises a single variable domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see, e.g., Bird et al. (1988) Science 242:423-426; and Huston et al. (1988) Proc. Natl. Acad. Sci. USA 85:5879-5883). Such single chain binding proteins are also intended to be encompassed within the term "antigen-binding portion" of a binding protein. Other forms of single chain binding proteins, such as diabodies are also encompassed. Diabodies are bivalent, bispecific binding proteins in which VH and VL domains are expressed on a single polypeptide chain, but using a linker that is too short to allow for pairing between the two domains on the same chain, thereby forcing the domains to pair with complementary domains of another chain and creating two antigen binding sites (see, e.g., Holliger, et al. (1993) Proc. Natl. Acad. Sci. USA 90:6444-6448; Poljak, et al. (1994) Structure 2:1121-1123).

The term "binding protein" refers to a polypeptide comprising one or more antigen-binding portions disclosed herein optionally linked to a linker polypeptide or a constant domain. Linker polypeptides comprise two or more amino acid residues joined by peptide bonds and are used to link one or more antigen binding portions. Such linker polypeptides are well known in the art (see e.g., Holliger, et al. (1993) Proc. Natl. Acad. Sci. USA 90:6444-6448; Poljak, et al. (1994) Structure 2:1121-1123). A constant domain refers to a heavy or light chain constant domain. Human IgG heavy chain and light chain constant domain amino acid sequences are known in the art and represented in Table 2.

TABLE 2

Sequence of Human IgG Heavy Chain Constant Domain and Light Chain Constant Domain

| Protein | Sequence Identifier | Sequence 123456789012345678901234567890123456789012 |
|---|---|---|
| Ig gamma-1 constant region | SEQ ID NO.: 2 | ASTKGPSVFPLAPSSKSTSGGTAALGCLVKDY FPEPVTVSWNSGALTSGVHTFPAVLQSSGLYS LSSVVTVPSSSLGTQTYICNVNHKPSNTKVDK KVEPKSCDKTHTCPPCPAPELLGGPSVFLFPP KPKDTLMISRTPEVTCVVVDVSHEDPEVKFNW YVDGVEVHNAKTKPREEQYNSTYRVVSVLTVL HQDWLNGKEYKCKVSNKALPAPIEKTISKAKG QPREPQVYTLPPSREEMTKNQVSLTCLVKGFY PSDIAVEWESNGQPENNYKTTPPVLDSDGSFF LYSKLTVDKSRWQQGNVFSCSVMHEALHNHYT QKSLSLSPGK |
| Ig gamma-1 constant region mutant | SEQ ID NO.: 3 | ASTKGPSVFPLAPSSKSTSGGTAALGCLVKDY FPEPVTVSWNSGALTSGVHTFPAVLQSSGLYS LSSVVTVPSSSLGTQTYICNVNHKPSNTKVDK KVEPKSCDKTHTCPPCPAPEAAGGPSVFLFPP KPKDTLMISRTPEVTCVVVDVSHEDPEVKFNW YVDGVEVHNAKTKPREEQYNSTYRVVSVLTVL HQDWLNGKEYKCKVSNKALPAPIEKTISKAKG QPREPQVYTLPPSREEMTKNQVSLTCLVKGFY PSDIAVEWESNGQPENNYKTTPPVLDSDGSFF LYSKLTVDKSRWQQGNVFSCSVMHEALHNHYT QKSLSLSPGK |
| Ig Kappa constant region | SEQ ID NO.: 4 | TVAAPSVFIFPPSDEQLKSGTASVVCLLNNFY PREAKVQWKVDNALQSGNSQESVTEQDSKDST YSLSSTLTLSKADYEKHKVYACEVTHQGLSSP VTKSFNRGEC |
| Ig Lambda constant region | SEQ ID NO.: 5 | QPKAAPSVTLFPPSSEELQANKATLVCLISDF YPGAVTVAWKADSSPVKAGVETTTPSKQSNNK YAASSYLSLTPEQWKSHRSYSCQVTHEGSTVE KTVAPTECS |

A binding protein, or antigen-binding portion thereof, may be part of a larger immunoadhesion molecule, formed by covalent or noncovalent association of the binding protein or binding protein portion with one or more other proteins or peptides. Examples of such immunoadhesion molecules include use of the streptavidin core region to make a tetrameric scFv molecule (Kipriyanov, et al. (1995) *Hum. Antibod. Hybridomas* 6:93-101) and use of a cysteine residue, a marker peptide and a C-terminal polyhistidine tag to make bivalent and biotinylated scFv molecules (Kipriyanov, et al. (1994) *Mol. Immunol.* 31:1047-1058). Antibody portions, such as Fab and F(ab')₂ fragments, can be prepared from whole antibodies using conventional techniques, such as papain or pepsin digestion, respectively, of whole antibodies. Moreover, binding proteins, binding protein portions and immunoadhesion molecules can be obtained using standard recombinant DNA techniques, as described herein.

An "isolated binding protein" refers to a binding protein, or antigen-binding portion thereof, that is substantially free of other binding proteins having different antigenic specificities (e.g., an isolated binding protein that specifically binds hTNF-α is substantially free of binding proteins that specifically bind antigens other than hTNF-α). An isolated binding protein that specifically binds hTNF-α may, however, have cross-reactivity to other antigens, such as TNF-α molecules from other species. Moreover, an isolated binding protein may be substantially free of other cellular material and/or chemicals.

The term "human binding protein" includes binding proteins, or antigen-binding portion thereof, that having variable and constant regions derived from human germline immunoglobulin sequences. The human binding proteins disclosed herein may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human binding protein", is not intended to include binding proteins in which CDR sequences derived from the germline of another mammalian species, such as a mouse, have been grafted onto human framework sequences.

The terms "Kabat numbering", "Kabat definitions" and "Kabat labeling" are used interchangeably herein. These terms, which are recognized in the art, refer to a system of numbering amino acid residues which are more variable (i.e., hypervariable) than other amino acid residues in the heavy and light chain variable regions of an antibody, or an antigen binding portion thereof (Kabat et al. (1971) *Ann. NY Acad. Sci.* 190:382-391 and Kabat, et al. (1991) Sequences of Proteins of Immunological Interest, Fifth Edition, U.S. Department of Health and Human Services, NIH Publication No. 91-3242). See also, Martin, "Protein Sequence and Structure Analysis of Antibody Variable Domains," In Kontermann and Dübel, eds., Antibody Engineering (Springer-Verlag, Berlin, 2001), Chapter 31, especially pages 432-433. For the heavy chain variable region, the hypervariable region ranges from amino acid positions 31 to 35 for CDR1, amino acid positions 50 to 65 for CDR2, and amino acid positions 95 to 106 for CDR3. For the light chain variable region, the hypervariable region ranges from amino acid positions 24 to 34 for CDR1, amino acid positions 50 to 56 for CDR2, and amino acid positions 89 to 97 for CDR3.

The term "CDR" refers to the complementarity determining region within antibody variable sequences. There are three CDRs in each of the variable regions of the heavy chain and the light chain, which are designated CDR1, CDR2 and CDR3, for each of the variable regions. The term "CDR set" refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia and Lesk (1987) *J. Mol. Biol.* 196:901-917) and Chothia et al. (1989) *Nature* 342:877-883) found that certain sub-portions within Kabat CDRs adopt nearly identical peptide backbone conformations, despite having great diversity at the level of amino acid sequence. These sub-portions were designated as L1, L2 and L3 or H1, H2 and H3 where the "L" and the "H" designates the light chain and the heavy chains regions, respectively. These regions may be referred to as Chothia CDRs, which have boundaries that overlap with Kabat CDRs. Other boundaries defining CDRs overlapping with the Kabat CDRs have been described by Padlan (1995) *FASEB J.* 9:133-139 and MacCallum (1996) *J. Mol. Biol.* 262(5):732-745. Still other CDR boundary definitions may not strictly follow one of the above systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although particular embodiments use Kabat or Chothia defined CDRs.

Human heavy chain and light chain acceptor sequences are known in the art. In one embodiment of the disclosure the human heavy chain and light chain acceptor sequences are selected from the sequences listed from V-base (hvbase.mrc-cpe.cam.ac.uk/) or from IMGT®, the international ImMunoGeneTics information System® (himgt.cines.fr/textes/IMGTrepertoire/LocusGenes/). In another embodiment of the disclosure the human heavy chain and light chain acceptor sequences are selected from the sequences described in Table 3 and Table 4, respectively.

TABLE 3

Heavy Chain Acceptor Sequences

| SEQ ID No. | Protein region | Sequence 123456789012345678901234567890012 |
|---|---|---|
| SEQ ID NO: 6 | VH4-59 FR1 | QVQLQESGPGLVKPSETLSLTCTVSGGSISS |
| SEQ ID NO: 7 | VH4-59 FR2 | WIRQPPGKGLEWIG |
| SEQ ID NO: 8 | VH4-59 FR3 | RVTISVDTSKNQFSLKLSSVTAADTAVYYCAR |
| SEQ ID NO: 9 | VH3-53 FR1 | EVQLVESGGGLIQPGGSLRLSCAASGFTVSS |
| SEQ ID NO: 10 | VH3-53 FR2 | WVRQAPGKGLEWVS |
| SEQ ID NO: 11 | VH3-53 FR3 | RFTISRDNSKNTLYLQMNSLRAEDTAVYYCAR |
| SEQ ID NO: 12 | JH1/JH4/ JH5 FR4 | WGQGTLVTVSS |
| SEQ ID NO: 13 | JH2 FR4 | WGRGTLVTVSS |
| SEQ ID NO: 14 | JH6 FR4 | WGQGTTVTVSS |

TABLE 4

Light Chain Acceptor Sequences

| SEQ ID No. | Protein region | Sequence 123456789012345678901234567890012 |
|---|---|---|
| SEQ ID NO: 15 | 1-39/O12 FR1 | DIQMTQSPSSLSASVGDRVTITC |
| SEQ ID NO: 16 | 1-39/O12 FR2 | WYQQKPGKAPKLLIY |
| SEQ ID NO: 17 | 1-39/O12 FR3 | GVPSRFSGSGSGTDFTLTISSLQPEDFATYYC |
| SEQ ID NO: 18 | 3-15/L2 FR1 | EIVMTQSPATLSVSPGERATLSC |
| SEQ ID NO: 19 | 3-15/L2 FR2 | WYQQKPGQAPRLLIY |
| SEQ ID NO: 20 | 3-15/L2 FR3 | GIPARFSGSGSGTEFTLTISSLQSEDFAVYYC |
| SEQ ID NO: 21 | JK2 FR4 | FGQGTKLEIKR |

The term "multivalent binding protein" is used in this specification to denote a binding protein comprising two or more antigen binding sites. The multivalent binding protein may be engineered to have the three or more antigen binding sites, and is generally not a naturally occurring antibody. The term "multispecific binding protein" refers to a binding protein capable of binding two or more related or unrelated targets. Dual variable domain (DVD) binding proteins or immunoglobulins (DVD-Ig) as used herein, are binding proteins that comprise two or more antigen binding sites and are tetravalent or multivalent binding proteins. Such DVD-binding proteins may be monospecific, i.e., capable of binding one antigen or multispecific, i.e., capable of binding two or more antigens. DVD-binding proteins comprising two heavy chain DVD-Ig polypeptides and two light chain DVD-Ig polypeptides are referred to a DVD-Ig. Each half of a DVD-Ig comprises a heavy chain DVD-Ig polypeptide, and a light chain DVD-Ig polypeptide, and two antigen binding sites. Each binding site comprises a heavy chain variable domain and a light chain variable domain with a total of 6 CDRs involved in antigen binding per antigen binding site. DVD binding proteins and methods of making DVD binding proteins are disclosed in U.S. Pat. No. 7,612,181.

One aspect of the disclosure pertains to a DVD binding protein comprising binding proteins capable of binding TNF-α. In a particular embodiment, the DVD binding protein is capable of binding TNF-α and a second target.

The term "neutralizing" refers to neutralization of a biological activity of a cytokine when a binding protein specifically binds the cytokine. In a particular embodiment, binding of a neutralizing binding protein to hTNF-α results in inhibition of a biological activity of hTNF-α, e.g., the neutralizing binding protein binds hTNF-α and reduces a biologically activity of hTNF-α by at least about 20%, 40%, 60%, 80%, 85% or more Inhibition of a biological activity of hTNF-α by a neutralizing binding protein can be assessed by measuring one or more indicators of hTNF-α biological activity well known in the art. For example neutralization of the cytoxicity of TNF-α on L929 cells.

In another embodiment, the terms "agonist" or "agonizing" refer to an increase of a biological activity of TNF-α when a binding protein specifically binds TNF-α, e.g., hTNF-α. In a particular embodiment, binding of an agonizing binding protein to TNF-α results in the increase of a biological activity of TNF-α. In a particular embodiment, the agonistic binding protein binds TNF-α and increases a biologically activity of TNF-α by at least about 20%, 40%, 60%, 80%, 85%, 90%, 95, 96%, 97%, 98%, 99%, and 100%. An inhibition of a biological activity of TNF-α by an agonistic binding protein can be assessed by measuring one or more indicators of TNF-α biological activity well known in the art.

The term "activity" includes activities such as the binding specificity/affinity of a binding protein for an antigen, for example, a hTNF-α binding protein that binds to a TNF-α antigen and/or the neutralizing potency (or agonizing potency) of a binding protein, for example, a hTNF-α binding protein whose binding to hTNF-α inhibits the biological activity of hTNF-α, e.g., neutralization of the cytoxicity of TNF-α on L929 cells.

The term "surface plasmon resonance" refers to an optical phenomenon that allows for the analysis of real-time bio specific interactions by detection of alterations in protein concentrations within a biosensor matrix, for example using the BIAcore system (Pharmacia Biosensor AB, Uppsala, Sweden and Piscataway, N.J.).

The term "$K_{on}$," refers to the on rate constant for association of a binding protein (e.g., an antibody) to the antigen to form, e.g., the antibody/antigen complex as is known in the art. The "$K_{on}$" also is known by the terms "association rate constant", or "ka", as used interchangeably herein. This value indicating the binding rate of an antibody to its target antigen or the rate of complex formation between an antibody and antigen also is shown by the equation below:

The term "$K_{off}$" refers to the off rate constant for dissociation, or "dissociation rate constant", of a binding protein (e.g., an antibody), from the, e.g., antibody/antigen complex as is known in the art. This value indicates the dissociation rate of an antibody from its target antigen or separation of Ab-Ag complex over time into free antibody and antigen as shown by the equation below:

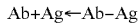

The term "$K_D$" refers to the "equilibrium dissociation constant" and refers to the value obtained in a titration measurement at equilibrium, or by dividing the dissociation rate constant ($K_{off}$) by the association rate constant ($K_{on}$). The association rate constant, the dissociation rate constant and the equilibrium dissociation constant are used to represent the binding affinity of an antibody to an antigen. Methods for determining association and dissociation rate constants are well known in the art. Using fluorescence-based techniques offers high sensitivity and the ability to examine samples in physiological buffers at equilibrium. Other experimental approaches and instruments such as a BIAcore® (biomolecular interaction analysis) assay can be used (e.g., instrument available from BIAcore International AB, a GE Healthcare company, Uppsala, Sweden). Additionally, a KinExA® (Kinetic Exclusion Assay) assay, available from Sapidyne Instruments (Boise, Id.) can also be used.

I. Binding Proteins that Bind Human TNF-α

One aspect of the present disclosure provides isolated fully-human anti-human TNF binding proteins, such as monoclonal antibodies, or antigen-binding portions thereof, that bind to TNF-α with high affinity, a slow off rate and high neutralizing capacity. A second aspect of the disclosure provides affinity-matured fully-human anti-TNF binding proteins, such as monoclonal antibodies, or antigen-binding portions thereof, that bind to TNF-α with high affinity, a slow off rate and high neutralizing capacity.

A. Method of Making TNF-α Binding Proteins

The binding proteins disclosed herein may be made by any of a number of techniques known in the art.

1. Anti-TNF-α Monoclonal Antibodies Using Transgenic Animals

In another embodiment of the disclosure, binding proteins are produced by immunizing a non-human animal comprising some, or all, of the human immunoglobulin locus with a TNF-α antigen. In a particular embodiment, the non-human animal is a XENOMOUSE transgenic mouse, an engineered mouse strain that comprises large fragments of the human immunoglobulin loci and is deficient in mouse antibody production. See, e.g., Green et al. (1994) Nature Genet. 7:13-21 and U.S. Pat. Nos. 5,916,771; 5,939,598; 5,985,615; 5,998,209; 6,075,181; 6,091,001; 6,114,598 and 6,130,364. See also PCT Publications WO 91/10741, published Jul. 25, 1991; WO 94/02602, published Feb. 3, 1994; WO 96/34096 and WO 96/33735, both published Oct. 31, 1996; WO 98/16654, published Apr. 23, 1998; WO 98/24893, published Jun. 11, 1998; WO 98/50433, published Nov. 12, 1998; WO 99/45031, published Sep. 10, 1999; WO 99/53049, published Oct. 21, 1999; WO 00/09560, published Feb. 24, 2000; and WO 00/37504, published Jun. 29, 2000. The XENOMOUSE transgenic mouse produces an adult-like human repertoire of fully human antibodies, and generates antigen-specific human Mabs. The XENOMOUSE transgenic mouse contains approximately 80% of the human antibody repertoire through introduction of megabase sized, germline configuration YAC fragments of the human heavy chain loci and x light chain loci. See, Mendez et al. (1997) Nature Genet. 15:146-156; Green and Jakobovits (1998) J. Exp. Med. 188:483-495.

2. Anti-TNF-α Monoclonal Antibodies Using Recombinant Antibody Libraries

In vitro methods also can be used to make the binding protein disclosed herein, wherein an antibody library is screened to identify an antibody having the desired binding specificity. Methods for such screening of recombinant antibody libraries are well known in the art and include methods described in, for example, U.S. Pat. No. 5,223,409; PCT Publications WO 92/18619; WO 91/17271; WO 92/20791; WO 92/15679; WO 93/01288; WO 92/01047; WO 92/09690; and WO 97/29131; Fuchs et al. (1991) Bio/Technology 9:1369-1372; Hay et al. (1992) Hum. Antibod. Hybridomas 3:81-85; Huse et al. (1989) Science 246: 1275-1281; McCafferty et al. (1990) Nature 348:552-554; Griffiths et al. (1993) EMBO J. 12:725-734; Hawkins et al. (1992) J. Mol. Biol. 226:889-896; Clackson et al. (1991) Nature 352:624-628; Gram et al. (1992) Proc. Natl. Acad. Sci. USA 89:3576-3580; Garrard et al. (1991) Bio/Technology 9:1373-1377; Hoogenboom et al. (1991) Nucl. Acid Res. 19:4133-4137; and Barbas et al. (1991) Proc. Natl. Acad. Sci. USA 88:7978-7982; and U.S. Patent Publication No. 2003.0186374.

The recombinant antibody library may be from a subject immunized with TNF-α, or a portion of TNF-α. Alternatively, the recombinant antibody library may be from a naïve subject, i.e., one who has not been immunized with TNF-α, such as a human antibody library from a human subject who has not been immunized with human TNF-α. Antibodies disclosed herein are selected by screening the recombinant antibody library with the peptide comprising human TNF-α to thereby select those antibodies that recognize TNF-α. Methods for conducting such screening and selection are well known in the art, such as described in the references in the preceding paragraph. To select antibodies disclosed herein having particular binding affinities for hTNF-α, such as those that dissociate from human TNF-α with a particular $k_{off}$ rate constant, the art-known method of surface plasmon resonance can be used to select antibodies having the desired $k_{off}$ rate constant. To select antibodies disclosed herein having a particular neutralizing activity for hTNF-α, such as those with a particular an $IC_{50}$, standard methods known in the art for assessing the inhibition of hTNF-α activity may be used.

In one aspect, provided is an isolated binding protein, or an antigen-binding portion thereof, that binds TNF-α, e.g., human TNF-α. In a particular embodiment, the binding protein is a neutralizing binding protein. In various embodiments, the binding protein is a recombinant binding protein or a monoclonal antibody.

For example, the binding proteins disclosed herein can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make the binding proteins disclosed herein can be found in the art.

As described in the above references, after phage selection, the binding protein coding regions from the phage can be isolated and used to generate whole binding proteins including human binding protein or any other desired antigen binding fragment, and expressed in any desired host, including mammalian cells, insect cells, plant cells, yeast, and bacteria, e.g., as described in detail below. For example, techniques to recombinantly produce Fab, Fab' and F(ab')$_2$ fragments can also be employed using methods known in the art such as those disclosed in PCT Publication WO 92/22324; Mullinax et al. (1992) BioTechniques 12(6):864-869; and Sawai et al. (1995) Am. J. Reprod. Immunol. 34:26-34; and Better et al. (1998) Science 240:1041-1043. Examples of techniques which can be used to produce single-chain Fvs and antibodies include those described in U.S. Pat. Nos. 4,946,778 and 5,258,498; Huston et al. (1991) Methods Enzymol. 203:46-88; Shu et al. (1993) Proc. Natl. Acad Sci. USA 90:7995-7999; and Skerra et al. (1998) Science 240:1038-1041.

Alternative to screening of recombinant antibody libraries by phage display, other methodologies known in the art for screening large combinatorial libraries can be applied to the identification of dual specificity binding protein disclosed herein. One type of alternative expression system is one in which the recombinant antibody library is expressed as RNA-protein fusions, as described in PCT Publication No. WO 98/31700 and in Roberts and Szostak (1997) Proc. Natl. Acad. Sci. USA 94:12297-12302. In this system, a covalent fusion is created between an mRNA and the peptide or protein that it encodes by in vitro translation of synthetic mRNAs that carry puromycin, a peptidyl acceptor antibiotic, at their 3' end. Thus, a specific mRNA can be enriched from a complex mixture of mRNAs (e.g., a combinatorial library) based on the properties of the encoded peptide or protein, e.g., antibody, or portion thereof, such as binding of the antibody, or portion thereof, to the dual specificity antigen. Nucleic acid sequences encoding antibodies, or portions thereof, recovered from screening of such libraries can be expressed by recombinant means as described above (e.g., in mammalian host cells) and, moreover, can be subjected to further affinity maturation by either additional rounds of screening of mRNA-peptide fusions in which mutations have been introduced into the originally selected sequence(s), or by other methods for affinity maturation in vitro of recombinant antibodies, as described above.

In another approach the binding proteins disclosed herein can also be generated using yeast display methods known in the art. In yeast display methods, genetic methods are used to tether antibody domains to the yeast cell wall and display them on the surface of yeast. In particular, such yeast can be utilized to display antigen-binding domains expressed from a repertoire or combinatorial antibody library (e.g., human or murine). Examples of yeast display methods that can be used to make the binding proteins disclosed herein include those disclosed Wittrup et al. U.S. Pat. No. 6,699,658 and Frenken et al., U.S. Pat. No. 6,114,147.

B. Production of Recombinant TNF-α Binding Proteins

Binding proteins disclosed herein may be produced by any of a number of techniques known in the art. For example, expression from host cells, wherein expression vector(s) encoding the heavy and light chains is (are) transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like. Although it is possible to express the binding proteins disclosed herein in either prokaryotic or eukaryotic host cells, expression of binding protein in eukaryotic cells is contemplated, for example, in mammalian host cells, because such eukaryotic cells (and in particular mammalian cells) are more likely than prokaryotic cells to assemble and secrete a properly folded and immunologically active binding protein.

Mammalian host cells for expressing the recombinant binding proteins disclosed herein include Chinese Hamster Ovary (CHO cells) (including dhfr-CHO cells, described in Urlaub and Chasin (1980) Proc. Natl. Acad. Sci. USA 77:4216-4220, used with a DHFR selectable marker, e.g., as described in Kaufman and Sharp (1982) J. Mol. Biol. 159:601-621), NS0 myeloma cells, COS cells and SP2 cells. When recombinant expression vectors encoding binding protein genes are introduced into mammalian host cells, the binding proteins are produced by culturing the host cells for a period of time sufficient to allow for expression of the binding protein in the host cells or, in particular, secretion of the antibody into the culture medium in which the host cells are grown. Antibodies can be recovered from the culture medium using standard protein purification methods.

Host cells can also be used to produce functional binding protein fragments, such as Fab fragments or scFv molecules. It will be understood that variations on the above procedure are within the scope of the present disclosure. For example, it may be desirable to transfect a host cell with DNA encoding functional fragments of either the light chain and/or the heavy chain of a binding protein disclosed herein. Recombinant DNA technology may also be used to remove some, or all, of the DNA encoding either or both of the light and heavy chains that is not necessary for binding to the antigens of interest. The molecules expressed from such truncated DNA molecules are also encompassed by the binding proteins disclosed herein. In addition, bifunctional binding proteins may be produced in which one heavy and one light chain are a binding protein disclosed herein and the other heavy and light chain are specific for an antigen other than the antigens of interest by crosslinking a binding protein disclosed herein to a second binding protein by standard chemical crosslinking methods.

In an exemplary system for recombinant expression of a binding protein, or antigen-binding portion thereof, disclosed herein, a recombinant expression vector encoding both the heavy chain and the light chain is introduced into dhfr CHO cells by calcium phosphate-mediated transfection. Within the recombinant expression vector, the heavy and light chain genes are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the heavy and light chains and intact binding protein is recovered from the culture medium. Standard molecular biology techniques are used to prepare the recombinant expression vector, transfect the host cells, select for transformants, culture the host cells and recover the binding protein from the culture medium. Still further a method of synthesizing a recombinant binding protein disclosed herein is provided by culturing a host cell disclosed herein in a suitable culture medium until a recombinant binding protein disclosed herein is synthesized. The method can further comprise isolating the recombinant binding protein from the culture medium.

II. hTNF-α Binding Proteins

A. Individual Clone Sequences

Table 5 provides the VH and VL sequences of fully human anti-human TNF binding proteins, including CDRs from each VH and VL sequence.

TABLE 5

Individual Fully Human Anti-TNF-α VH Sequences

| Protein region | | | Sequence 12345678901234567890123456789 0 |
|---|---|---|---|
| AE11-1 VH | | SEQ ID NO.: 22 | EVQLVQSGAEVKKPGASVKVSCKASGYTFT SYDVNWVRQATGQGLEWMGWMNPNSGNTGY AQKFQGRVTITADESTSTAYMELSSLRSED TAVYYCAIFDSDYMDVWGKGTLVTVSS |
| AE11-1 VH | CDR-H1 | Residues 31-35 of SEQ ID NO.: 22 | SYDVN |
| AE11-1 VH | CDR-H2 | Residues 50-66 of SEQ ID NO.: 22 | WMNPNSGNTGYAQKFQG |
| AE11-1 VH | CDR-H3 | Residues 99-106 of SEQ ID NO.: 22 | FDSDYMDV |
| AE11-1 VL | | SEQ ID NO.: 23 | SYELTQPPSVSLSPGQTARITCSGDALPKQ YAYWYQQKPGQAPVLVIYKDTERPSGIPER FSGSSSGTTVTLTISGAQAEDEADYYCQSA DSSGTSWVFGGGTKLTVL |
| AE11-1 VL | CDR-L1 | Residues 23-33 of SEQ ID NO.: 23 | SGDALPKQYAY |
| AE11-1 VL | CDR-L2 | Residues 49-55 of SEQ ID NO.: 23 | KDTERPS |
| AE11-1 VL | CDR-L3 | Residues 89-98 of SEQ ID NO.: 23 | SADSSGTSWV |
| AE11-5 VH | | SEQ ID NO.: 24 | EVQLVQSGAEVKKPGSSAKVSCKASGGTFS SYAISWVRQAPGQGLEWMGGIIPILGTANY AQKFLGRVTITADESTSTVYMELSSLRSED TAVYYCARGLYYDPTRADYWGQGTLVTVSS |
| AE11-5 VH | CDR-H1 | Residues 31-35 of SEQ ID NO.: 24 | SYAIS |
| AE11-5 VH | CDR-H2 | Residues 50-66 of SEQ ID NO.: 24 | GIIPILGTANYAQKFLG |
| AE11-5 VH | CDR-H3 | Residues 99-109 of SEQ ID NO.: 24 | GLYYDPTRADY |
| AE11-5 VL | | SEQ ID NO.: 25 | DIVMTQSPDFHSVTPKEKVTITCRASQSIG SSLHWYQQKPDQSPKLLIRHASQSISGVPS RFSGSGSGTDFTLTIHSLEAEDAATYYCHQ SSSSPPPTFGQGTQVEIK |
| AE11-5 VL | CDR-L1 | Residues 24-34 of SEQ ID NO.: 25 | RASQSIGSSLH |
| AE11-5 VL | CDR-L2 | Residues 50-56 of SEQ ID NO.: 25 | HASQSIS |
| AE11-5 VL | CDR-L3 | Residues 89-98 of SEQ ID NO.: 25 | HQSSSSPPPT |
| TNF-JK1 VH | | SEQ ID NO.: 26 | EVQLVESGGGLVQPGGSLRLSCATSGFTFN NYWMSWVRQAPGKGLEWVANINHDESEKYY VDSAKGRFTISRDNAEKSLFLQMNSLRAED TAVYYCARIIRGRVGFDYYNYAMDVWGQGT LVTVSS |

TABLE 5-continued

Individual Fully Human Anti-TNF-α VH Sequences

| Protein region | | | Sequence 12345678901234567890123456789 0 |
|---|---|---|---|
| TNF-JK1 VH | CDR-H1 | Residues 31-35 of SEQ ID NO.: 26 | NYWMS |
| TNF-JK1 VH | CDR-H2 | Residues 50-66 of SEQ ID NO.: 26 | NINHDESEKYYVDSAKG |
| TNF-JK1 VH | CDR-H3 | Residues 99-115 of SEQ ID NO.: 26 | IIRGRVGFDYYNYAMDV |
| TNF-JK1 VL | | SEQ ID NO.: 27 | DIRLTQSPSPLSASVGDRVTITCRASQSIG NYLNWYQHKPGKAPKLLIYAASSLQSGVPS RFSGTGSGTDFTLTISSLQPEDFATYYCQE SYSLIFAGGTKVEIK |
| TNF-JK1 VL | CDR-L1 | Residues 24-34 of SEQ ID NO.: 27 | RASQSIGNYLN |
| TNF-JK1 VL | CDR-L2 | Residues 50-56 of SEQ ID NO.: 27 | AASSLQS |
| TNF-JK1 VL | CDR-L3 | Residues 89-95 of SEQ ID NO.: 27 | QESYSLI |
| TNF-Y7C VH | | SEQ ID NO.: 28 | EVQLVQSGAEVKKPGASVKVSCKTSGYTFS NYDINWVRQPTGQGLEWMGWMDPNNGNTGY AQKFVGRVTMTRDTSKTTAYLELSGLKSED TAVYYCARSSGSGGTWYKEYFQSWGQGTMV TVSS |
| TNF-Y7C VH | CDR-H1 | Residues 31-35 of SEQ ID NO.: 28 | NYDIN |
| TNF-Y7C VH | CDR-H2 | Residues 50-66 of SEQ ID NO.: 28 | WMDPNNGNTGYAQKFVG |
| TNF-Y7C VH | CDR-H3 | Residues 99-112 of SEQ ID NO.: 28 | KSSGSGGTWYKEYFQS |
| TNF-Y7C VL | | SEQ ID NO.: 29 | DIVMTQSPLSLPVTPGEPASISCRSSQSLL HSNGYNYLDWYLQKPGQFPQLLIYLGSYRA SGVPDRFSGSGSGTDFTLKISRVEAEDVGV YYCMQRIEFPPGTFGQGTKLGIK |
| TNF-Y7C VL | CDR-L1 | Residues 24-39 of SEQ ID NO.: 29 | RSSQSLLHSNGYNYLD |
| TNF-Y7C VL | CDR-L2 | Residues 55-61 of SEQ ID NO.: 29 | LGSYRAS |
| TNF-Y7C VL | CDR-L3 | Residues 94-103 of SEQ ID NO.: 29 | MQRIEFPPGT |
| AE11-7 VH | | SEQ ID NO.: 30 | EVQLVQSGAEVKKPGASVKVSCKTSGYSLT QYPIHWVRQAPGQRPEWMGWISPGNGNTKL SPKFQGRVTLSRDASAGTVFMDLSGLTSDD TAVYFCTSVDLGDHWGQGTLVTVSS |
| AE11-7 VH | CDR-H1 | Residues 31-35 of SEQ ID NO.: 30 | QYPIH |
| AE11-7 VH | CDR-H2 | Residues 50-66 of SEQ ID NO.: 30 | WISPGNGNTKLSPKFQG |
| AE11-7 VH | CDR-H3 | Residues 99-104 of SEQ ID NO.: 30 | VDLGDH |
| AE11-7 VL | | SEQ ID NO.: 31 | DIVMTQSPEFQSVTPKEKVTITCRASQSIG SSLHWYQQKPDQSPKLLINYASQSFSGVPS RFSGGGSGTDFTLTINSLEAEDAATYYCHQ SSNLPITFGQGTRLEIK |

TABLE 5-continued

Individual Fully Human Anti-TNF-α VH Sequences

| Protein region | | | Sequence 12345678901234567890123456789 0 |
|---|---|---|---|
| AE11-7 VL | CDR-L1 | Residues 24-34 of SEQ ID NO.: 31 | RASQSIGSSLH |
| AE11-7 VL | CDR-L2 | Residues 50-56 of SEQ ID NO.: 31 | YASQSFS |
| AE11-7 VL | CDR-L3 | Residues 89-97 of SEQ ID NO.: 31 | HQSSNLPIT |
| AE11-13 VH | | SEQ ID NO.: 32 | EVQLVESGGGLVQPGRSLRLSCAASGFTFDDYPMHWVRQAPGEGLEWVSGISSNSASIGYADSVKGRFTISRDNAQNTLYLQMNSLGDEDTAVYYCVSLTLGIGQGTLVTVSS |
| AE11-13 VH | CDR-H1 | Residues 31-35 of SEQ ID NO.: 32 | DYPMH |
| AE11-13 VH | CDR-H2 | Residues 50-66 of SEQ ID NO.: 32 | GISSNSASIGYADSVKG |
| AE11-13 VH | CDR-H3 | Residues 99-102 of SEQ ID NO.: 32 | LTLG |
| AE11-13 VL | | SEQ ID NO.: 33 | DIRLTQSPSSLSASVGDRVTITCRASQSIGNYLHWYQQKPGKAPKLLIYAASSLQSGVPSRFSGSGSGTDFTLTISSLQPEDFATYYCQQSYSTLYSFGQGTKLEIK |
| AE11-13 VL | CDR-L1 | Residues 24-34 of SEQ ID NO.: 33 | RASQSIGNYLH |
| AE11-13 VL | CDR-L2 | Residues 50-56 of SEQ ID NO.: 33 | AASSLQS |
| AE11-13 VL | CDR-L3 | Residues 89-97 of SEQ ID NO.: 33 | QQSYSTLYS |

B. IgG Converted Clones

Table 6 provides the VH sequence of humanized anti-TNF MAK-195 antibodies that were converted into IgG clones as discussed in detail in Example 2.

TABLE 6

Humanized anti-TNF MAK-195 Ab VH sequences of IgG converted clones

| Protein region | | | Sequence 12345678901234567890123456789 0 |
|---|---|---|---|
| A8 VH | | SEQ ID NO.: 34 | EVQLVESGGGLVQPGGSLRLSCAASGFTFSNYGVNWVRQAPGKGLEWVSMIAADGFTDYASSVKGRFTISRDNSKNTLYLQMNSLRAEDTAVYYCAREWHHGPVAYWGQGTLVTVSS |
| A8 VH | CDR-H1 | Residues 31-35 of SEQ ID NO.: 34 | NYGVN |
| A8 VH | CDR-H2 | Residues 50-65 of SEQ ID NO.: 34 | MIAADGFTDYASSVKG |
| A8 VH | CDR-H3 | Residues 98-106 of SEQ ID NO.: 34 | EWHHGPVAY |
| B5 VH | | SEQ ID NO.: 35 | EVQLVESGGGLVQPGGSLRLSCAASGFTFSNYGVSWVRQAPGKGLEWVSLIRGDGSTDYASSLKGRFTISRDNSKNTLYLQMNSLRAEDTAVYYCAREWHHGPVAYWGQGTLVTVSS |
| B5 VH | CDR-H1 | Residues 31-35 of SEQ ID NO.: 35 | NYGVS |

TABLE 6-continued

Humanized anti-TNF MAK-195 Ab VH sequences of IgG converted clones

| Protein region | | Sequence<br>12345678901234567890123456780 |
|---|---|---|
| B5 VH | CDR-H2 Residues 50-65 of SEQ ID NO.: 35 | LIRGDGSTDYASSLKG |
| B5 VH | CDR-H3 Residues 98-106 of SEQ ID NO.: 35 | EWHHGPVAY |
| rHC44 VH | SEQ ID NO.: 36 | EVQLVESGGGLVQPGGSLRLSCAASGFTFSNYGVSWVRQAPGKGLEWVSMIWADGSTHYADTLKSRFTISRDNSKNTLYLQMNSLRAEDTAVYYCAREWQHGPVAYWGQGTLVTVSS |
| rHC44 VH | CDR-H1 Residues 31-35 of SEQ ID NO.: 36 | NYGVS |
| rHC44 VH | CDR-H2 Residues 50-65 of SEQ ID NO.: 36 | MIWADGSTHYADTLKS |
| rHC44 VH | CDR-H3 Residues 98-106 of SEQ ID NO.: 36 | EWQHGPVAY |
| rHC22 VH | SEQ ID NO.: 37 | EVQLVESGGGLVQPGGSLRLSCAASGFTFSNYGVTWVRQAPGKGLEWVSMIWADGSTDYADTVKGRFTISRDNSKNTLYLQMNSLRAEDTAVYYCAREWQHGPVAYWGQGTLVTVSS |
| rHC22 VH | CDR-H1 Residues 31-35 of SEQ ID NO.: 37 | NYGVT |
| rHC22 VH | CDR-H2 Residues 50-65 of SEQ ID NO.: 37 | MIWADGSTDYADTVKG |
| rHC22 VH | CDR-H3 Residues 98-106 of SEQ ID NO.: 37 | EWQHGPVAY |
| rHC81 VH | SEQ ID NO.: 38 | EVQLVESGGGLVQPGGSLRLSCAASGFTFSNYGVTWVRQAPGKGLEWVSMIWADGSTHYADSVKSRFTISRDNSKNTLYLQMNSLRAEDTAVYYCAREWQHGPLAYWGQGTLVTVSS |
| rHC81 VH | CDR-H1 Residues 31-35 of SEQ ID NO.: 38 | NYGVT |
| rHC81 VH | CDR-H2 Residues 50-65 of SEQ ID NO.: 38 | MIWADGSTHYADSVKS |
| rHC81 VH | CDR-H3 Residues 98-106 of SEQ ID NO.: 38 | EWQHGPLAY |
| rHC18 VH | SEQ ID NO.: 39 | EVQLVESGGGLVQPGGSLRLSCAASGFTFSNYGVTWVRQAPGKGLEWVSMIWSDGSTDYASSVKGRFTISRDNSKNTLYLQMNSLRAEDTAVYYCAREWQHGPVAYWGQGTLVTVSS |
| rHC18 VH | CDR-H1 Residues 31-35 of SEQ ID NO.: 39 | NYGVT |
| rHC18 VH | CDR-H2 Residues 50-65 of SEQ ID NO.: 39 | MIWSDGSTDYASSVKG |
| rHC18 VH | CDR-H3 Residues 98-106 of SEQ ID NO.: 39 | EWQHGPVAY |
| rHC14 VH | SEQ ID NO.: 40 | EVQLVESGGGLVQPGGSLRLSCAASGFTFSNYGVTWVRQAPGKGLEWVSMIWADGSTHYASSLKGRFTISRDNSKNTLYLQMNSLRAEDTAVYYCAREWQHGPAAYWGQGTLVTVSS |
| rHC14 VH | CDR-H1 Residues 31-35 of SEQ ID NO.: 40 | NYGVT |
| rHC14 VH | CDR-H2 Residues 50-65 of SEQ ID NO.: 40 | MIWADGSTHYASSLKG |

TABLE 6-continued

Humanized anti-TNF MAK-195 Ab VH sequences of IgG converted clones

| Protein region | | | Sequence 12345678901234567890123456789 0 |
|---|---|---|---|
| rHC14 VH | CDR-H3 | Residues 98-106 of SEQ ID NO.: 40 | EWQHGPAAY |
| rHC3 VH | | SEQ ID NO.: 41 | EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPVAYWGQGTLVTVSS |
| rHC3 VH | CDR-H1 | Residues 31-35 of SEQ ID NO.: 41 | NYGVS |
| rHC3 VH | CDR-H2 | Residues 50-65 of SEQ ID NO.: 41 | MIWADGSTHYASSLKG |
| rHC3 VH | CDR-H3 | Residues 98-106 of SEQ ID NO.: 41 | EWQHGPVAY |
| rHC19 VH | | SEQ ID NO.: 42 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPAAYWGQGTLVTVSS |
| rHC19 VH | CDR-H1 | Residues 31-35 of SEQ ID NO.: 42 | NYGVT |
| rHC19 VH | CDR-H2 | Residues 50-65 of SEQ ID NO.: 42 | MIWADGSTHYASSVKG |
| rHC19 VH | CDR-H3 | Residues 98-106 of SEQ ID NO.: 42 | EWQHGPAAY |
| rHC34 VH | | SEQ ID NO.: 43 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPSAYWGQGTLVTVSS |
| rHC34 VH | CDR-H1 | Residues 31-35 of SEQ ID NO.: 43 | NYGVT |
| rHC34 VH | CDR-H2 | Residues 50-65 of SEQ ID NO.: 43 | MIWADGSTHYASSVKG |
| rHC34 VH | CDR-H3 | Residues 98-106 of SEQ ID NO.: 43 | EWQHGPSAY |
| rHC83 VH | | SEQ ID NO.: 44 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| rHC83 VH | CDR-H1 | Residues 31-35 of SEQ ID NO.: 44 | NYGVT |
| rHC83 VH | CDR-H2 | Residues 50-65 of SEQ ID NO.: 44 | MIWADGSTHYASSVKG |
| rHC83 VH | CDR-H3 | Residues 98-106 of SEQ ID NO.: 44 | EWQHGPVAY |
| S4-19 VH | | SEQ ID NO.: 45 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| S4-19 VH | CDR-H1 | Residues 31-35 of SEQ ID NO.: 45 | NYGVE |
| S4-19 VH | CDR-H2 | Residues 50-65 of SEQ ID NO.: 45 | GIWADGSTHYADTVKS |
| S4-19 VH | CDR-H3 | Residues 98-106 of SEQ ID NO.: 45 | EWQHGPVAY |

TABLE 6-continued

Humanized anti-TNF MAK-195 Ab VH sequences of
IgG converted clones

| Protein region | | Sequence<br>123456789012345678901234567890 |
|---|---|---|
| S4-50<br>VH | SEQ ID NO.: 46 | EVQLVESGGGLVQPGGSLRLSCAASGFTFS<br>NYGVEWVRQAPGKGLEWVSGIWADGSTHYA<br>DTVKSRFTISRDNSKNTLYLQMNSLRAEDT<br>AVYYCAREWQHGPVGYWGQGTLVTVSS |
| S4-50<br>VH | CDR-H1 Residues 31-35<br>of SEQ ID<br>NO.: 46 | NYGVE |
| S4-50<br>VH | CDR-H2 Residues 50-65<br>of SEQ ID<br>NO.: 46 | GIWADGSTHYADTVKS |
| S4-50<br>VH | CDR-H3 Residues 98-106<br>of SEQ ID<br>NO.: 46 | EWQHGPVGY |
| S4-63<br>VH | SEQ ID NO.: 47 | EVQLVESGGGLVQPGGSLRLSCAASGFTFS<br>NYGVEWVRQAPGKGLEWVSGIWADGSTHYA<br>DTVKSRFTISRDNSKNTLYLQMNSLRAEDT<br>AVYYCAREWQHGPVGYWGQGTLVTVSS |
| S4-63<br>VH | CDR-H1 Residues 31-35<br>of SEQ ID<br>NO.: 47 | NYGVE |
| S4-63<br>VH | CDR-H2 Residues 50-65<br>of SEQ ID<br>NO.: 47 | GIWADGSTHYADTVKS |
| S4-63<br>VH | CDR-H3 Residues 98-106<br>of SEQ ID<br>NO.: 47 | EWQHGPVGY |
| S4-55<br>VH | SEQ ID NO.: 48 | EVQLVESGGGLVQPGGSLRLSCAASGFTFS<br>NYGVTWVRQAPGKGLEWVSMIWADGSTDYA<br>STVKGRFTISRDNSKNTLYLQMNSLRAEDT<br>AVYYCAREWQHGPVGYWGQGTLVTVSS |
| S4-55<br>VH | CDR-H1 Residues 31-35<br>of SEQ ID<br>NO.: 48 | NYGVT |
| S4-55<br>VH | CDR-H2 Residues 50-65<br>of SEQ ID<br>NO.: 48 | MIWADGSTDYASTVKG |
| S4-55<br>VH | CDR-H3 Residues 98-106<br>of SEQ ID<br>NO.: 48 | EWQHGPVGY |
| S4-6<br>VH | SEQ ID NO.: 49 | EVQLVESGGGLVQPGGSLRLSCAASGFTFS<br>NYGVTWVRQAPGKGLEWVSMIWADGSTHYA<br>SSVKGRFTISRDNSKNTLYLQMNSLRAEDT<br>AVYYCAREWQHGPVAYWGQGTLVTVSS |
| S4-6<br>VH | CDR-H1 Residues 31-35<br>of SEQ ID<br>NO.: 49 | NYGVT |
| S4-6<br>VH | CDR-H2 Residues 50-65<br>of SEQ ID<br>NO.: 49 | MIWADGSTHYASSVKG |
| S4-6<br>VH | CDR-H3 Residues 98-106<br>of SEQ ID<br>NO.: 49 | EWQHGPVAY |
| S4-18<br>VH | SEQ ID NO.: 50 | EVQLVESGGGLVQPGGSLRLSCAASGFTFS<br>NYGVTWVRQAPGKGLEWVSMIWADGSTHYA<br>DSVKSRFTISRDNSKNTLYLQMNSLRAEDT<br>AVYYCAREWQHGPLAYWGQGTLVTVSS |
| S4-18<br>VH | CDR-H1 Residues 31-35<br>of SEQ ID<br>NO.: 50 | NYGVT |
| S4-18<br>VH | CDR-H2 Residues 50-65<br>of SEQ ID<br>NO.: 50 | MIWADGSTHYADSVKS |
| S4-18<br>VH | CDR-H3 Residues 98-106<br>of SEQ ID<br>NO.: 50 | EWQHGPLAY |
| S4-31<br>VH | SEQ ID NO.:51 | EVQLVESGGGLVQPGGSLRLSCAASGFTFS<br>NYGVQWVRQAPGKGLEWVSGIGADGSTAYA<br>SSLKGRFTISRDNSKNTLYLQMNSLRAEDT<br>AVYYCAREWQHSGLAYWGQGTLVTVSS |

TABLE 6-continued

Humanized anti-TNF MAK-195 Ab VH sequences of IgG converted clones

| Protein region | | Sequence 12345678901234567890123456 7890 |
|---|---|---|
| S4-31 VH | CDR-H1 Residues 31-35 of SEQ ID NO.: 51 | NYGVQ |
| S4-31 VH | CDR-H2 Residues 50-65 of SEQ ID NO.: 51 | GIGADGSTAYASSLKG |
| S4-31 VH | CDR-H3 Residues 98-106 of SEQ ID NO.: 51 | EWQHSGLAY |
| S4-34 VH | SEQ ID NO.: 52 | EVQLVESGGGLVQPGGSLRLSCAASGFTFSNYGVSWVRQAPGKGLEWVSMIWADGSTHYADTVKGRFTISRDNSKNTLYLQMNSLRAEDTAVYYCAREWQHGPLAYWGQGTLVTVSS |
| S4-34 VH | CDR-H1 Residues 31-35 of SEQ ID NO.: 52 | NYGVS |
| S4-34 VH | CDR-H2 Residues 50-65 of SEQ ID NO.: 52 | MIWADGSTHYADTVKG |
| S4-34 VH | CDR-H3 Residues 98-106 of SEQ ID NO.: 52 | EWQHGPLAY |
| S4-74 VH | SEQ ID NO.: 53 | EVQLVESGGGLVQPGGSLRLSCAASGFTFSNYGVTWVRQAPGKGLEWVSMIWADGSTHYADTVKGRFTISRDNSKNTLYLQMNSLRAEDTAVYYCAREWQHGPLAYWGQGTLVTVSS |
| S4-74 VH | CDR-H1 Residues 31-35 of SEQ ID NO.: 53 | NYGVT |
| S4-74 VH | CDR-H2 Residues 50-65 of SEQ ID NO.: 53 | MIWADGSTHYADTVKG |
| S4-74 VH | CDR-H3 Residues 98-106 of SEQ ID NO.: 53 | EWQHGPLAY |
| S4-12 VH | SEQ ID NO.: 54 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-12 VH | CDR-H1 Residues 31-35 of SEQ ID NO.: 54 | NYGVT |
| S4-12 VH | CDR-H2 Residues 50-65 of SEQ ID NO.: 54 | MIWADGSTHYASSVKG |
| S4-12 VH | CDR-H3 Residues 98-106 of SEQ ID NO.: 54 | EWQHGPVAY |
| S4-54 VH | SEQ ID NO.: 55 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-54 VH | CDR-H1 Residues 31-35 of SEQ ID NO.: 55 | NYGVT |
| S4-54 VH | CDR-H2 Residues 50-65 of SEQ ID NO.: 55 | MIWADGSTHYASSVKG |
| S4-54 VH | CDR-H3 Residues 98-106 of SEQ ID NO.: 55 | EWQHGPVAY |
| S4-17 VH | SEQ ID NO.: 56 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-17 VH | CDR-H1 Residues 31-35 of SEQ ID NO.: 56 | NYGVT |

TABLE 6-continued

Humanized anti-TNF MAK-195 Ab VH sequences of IgG converted clones

| Protein region | | Sequence<br>12345678901234567890123456 7890 |
|---|---|---|
| S4-17 VH | CDR-H2 Residues 50-65 of SEQ ID NO.: 56 | MIWADGSTHYASSVKG |
| S4-17 VH | CDR-H3 Residues 98-106 of SEQ ID NO.: 56 | EWQHGPVAY |
| S4-40 VH | SEQ ID NO.: 57 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-40 VH | CDR-H1 Residues 31-35 of SEQ ID NO.: 57 | NYGVT |
| S4-40 VH | CDR-H2 Residues 50-65 of SEQ ID NO.: 57 | MIWADGSTHYASSVKG |
| S4-40 VH | CDR-H3 Residues 98-106 of SEQ ID NO.: 57 | EWQHGPVAY |
| S4-24 VH | SEQ ID NO.: 58 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-24 VH | CDR-H1 Residues 31-35 of SEQ ID NO.: 58 | NYGVT |
| S4-24 VH | CDR-H2 Residues 50-65 of SEQ ID NO.: 58 | MIWADGSTHYASSVKG |
| S4-24 VH | CDR-H3 Residues 98-106 of SEQ ID NO.: 58 | EWQHGPVAY |

Table 7 provides VL sequences of IgG converted clones for Humanized anti-TNF MAK-195 antibodies as discussed in detail in Example 2.

TABLE 7

Humanized anti-TNF MAK-195 Ab VL sequences of IgG converted clones

| Protein region | | Sequence<br>12345678901234567890123456 7890 |
|---|---|---|
| hMAK195 VL.1 VL | SEQ ID NO.: 59 | DIQMTQSPSSLSASVGDRVTITCKASQAVSSAVAWYQQKPGKAPKLLIYWASTRHTGVPSRFSGSGSGTDFTLTISSLQPEDFATYYCQQHYSTPFTFGQGTKLEIKR |
| hMAK195 VL.1 VL | CDR-L1 Residues 24-34 of SEQ ID NO.: 59 | KASQAVSSAVA |
| hMAK195 VL.1 VL | CDR-L2 Residues 50-56 of SEQ ID NO.: 59 | WASTRHT |
| hMAK195 VL.1 VL | CDR-L3 Residues 89-97 of SEQ ID NO.: 59 | QQHYSTPFT |
| S4-24 VL | SEQ ID NO.: 60 | DIQMTQSPSSLSASVGDRVTITCRASQLVSSAVAWYQQKPGKAPKLLIYWASTLHTGVPSRFSGSGSGTDFTLTISSLQPEDFATYYCQQHYRTPFTFGQGTKLEIKR |
| S4-24 VL | CDR-L1 Residues 24-34 of SEQ ID NO.: 60 | RASQLVSSAVA |
| S4-24 VL | CDR-L2 Residues 50-56 of SEQ ID NO.: 60 | WASTLHT |

TABLE 7-continued

Humanized anti-TNF MAK-195 Ab VL sequences of IgG converted clones

| Protein region | | Sequence<br>12345678901234567890123456789 0 |
|---|---|---|
| S4-24 VL | CDR-L3 Residues 89-97 of SEQ ID NO.: 60 | QQHYRTPFT |
| S4-40 VL | SEQ ID NO.: 61 | DIQMTQSPSSLSASVGDRVTITCRASQLVS SAVAWYQQKPGKAPKLLIYWASTRHSGVPS RFSGSGSGTDFTLTISSLQPEDFATYYCQQ HYRTPFSFGQGTKLEIKR |
| S4-40 VL | CDR-L1 Residues 24-34 of SEQ ID NO.: 61 | RASQLVSSAVA |
| S4-40 VL | CDR-L2 Residues 50-56 of SEQ ID NO.: 61 | WASTRHS |
| S4-40 VL | CDR-L3 Residues 89-97 of SEQ ID NO.: 61 | QQHYRTPFS |
| S4-17 VL | SEQ ID NO.: 62 | DIQMTQSPSSLSASVGDRVTITCRASQLVS SAVAWYQQKPGKAPKLLIYWASTRHSGVPS RFSGSGSGTDFTLTISSLQPEDFATYYCQQ HYRTPFTFGQGTKLEIKR |
| S4-17 VL | CDR-L1 Residues 24-34 of SEQ ID NO.: 62 | RASQLVSSAVA |
| S4-17 VL | CDR-L2 Residues 50-56 of SEQ ID NO.: 62 | WASTRHS |
| S4-17 VL | CDR-L3 Residues 89-97 of SEQ ID NO.: 62 | QQHYRTPFT |
| S4-54 VL | SEQ ID NO.: 63 | DIQMTQSPSSLSASVGDRVTITCRASQLVS SAVAWYQQKPGKAPKLLIYWASARHTGVPS RFSGSGSGTDFTLTISSLQPEDFATYYCQQ HYKTPFSFGQGTKLEIKR |
| S4-54 VL | CDR-L1 Residues 24-34 of SEQ ID NO.: 63 | RASQLVSSAVA |
| S4-54 VL | CDR-L2 Residues 50-56 of SEQ ID NO.: 63 | WASARHT |
| S4-54 VL | CDR-L3 Residues 89-97 of SEQ ID NO.: 63 | QQHYKTPFS |
| S4-12 VL | SEQ ID NO.: 64 | DIQMTQSPSSLSASVGDRVTITCRASQLVS SAVAWYQQKPGKAPKLLIYWASARHTGVPS RFSGSGSGTDFTLTISSLQPEDFATYYCQQ HYKTPFTFGQGTKLEIKR |
| S4-12 VL | CDR-L1 Residues 24-34 of SEQ ID NO.: 64 | RASQLVSSAVA |
| S4-12 VL | CDR-L2 Residues 50-56 of SEQ ID NO.: 64 | WASARHT |
| S4-12 VL | CDR-L3 Residues 89-97 of SEQ ID NO.: 64 | QQHYKTPFT |
| S4-74 VL | SEQ ID NO.: 65 | DIQMTQSPSSLSASVGDRVTITCRASQLVS SAVAWYQQKPGKAPKLLIYWASARHTGVPS RFSGSGSGTDFTLTISSLQPEDFATYYCQQ HYRTPFTFGQGTKLEIKR |
| S4-74 VL | CDR-L1 Residues 24-34 of SEQ ID NO.: 65 | RASQLVSSAVA |
| S4-74 VL | CDR-L2 Residues 50-56 of SEQ ID NO.: 65 | WASARHT |
| S4-74 VL | CDR-L3 Residues 89-97 of SEQ ID NO.: 65 | QQHYRTPFT |

TABLE 7-continued

Humanized anti-TNF MAK-195 Ab VL sequences of IgG converted clones

| Protein region | | Sequence 12345678901234567890123456789 0 |
|---|---|---|
| S4-34 VL | SEQ ID NO.: 66 | DIQMTQSPSSLSASVGDRVTITCRASQLVS SAVAWYQQKPGKAPKLLIYWASTRHTGVPS RFSGSGSGTDFTLTISSLQPEDFATYYCQQ HYRTPFTFGQGTKLEIKR |
| S4-34 VL | CDR-L1 Residues 24-34 of SEQ ID NO.: 66 | RASQLVSSAVA |
| S4-34 VL | CDR-L2 Residues 50-56 of SEQ ID NO.: 66 | WASTRHT |
| S4-34 VL | CDR-L3 Residues 89-97 of SEQ ID NO.: 66 | QQHYRTPFT |
| S4-31 VL | SEQ ID NO.: 67 | DIQMTQSPSSLSASVGDRVTITCRASQGVS SALAWYQQKPGKAPKLLIYWASALHSGVPS RFSGSGSGTDFTLTISSLQPEDFATYYCQQ HYSAPFTFGQGTKLEIKR |
| S4-31 VL | CDR-L1 Residues 24-34 of SEQ ID NO.: 67 | RASQGVSSALA |
| S4-31 VL | CDR-L2 Residues 50-56 of SEQ ID NO.: 67 | WASALHS |
| S4-31 VL | CDR-L3 Residues 89-97 of SEQ ID NO.: 67 | QQHYSAPFT |
| S4-18 VL | SEQ ID NO.: 68 | DIQMTQSPSSLSASVGDRVTITCRASQLVS SAVAWYQQKPGKAPKLLIYWASTLHSGVPS RFSGSGSGTDFTLTISSLQPEDFATYYCQQ HYSTPFTFGQGTKLEIKR |
| S4-18 VL | CDR-L1 Residues 24-34 of SEQ ID NO.: 68 | RASQLVSSAVA |
| S4-18 VL | CDR-L2 Residues 50-56 of SEQ ID NO.: 68 | WASTLHS |
| S4-18 VL | CDR-L3 Residues 89-97 of SEQ ID NO.: 68 | QQHYSTPFT |
| S4-6 VL | SEQ ID NO.: 69 | DIQMTQSPSSLSASVGDRVTITCKASQLVS SAVAWYQQKPGKAPKLLIYWASTRHTGVPS RFSGSGSGTDFTLTISSLQPEDFATYYCQQ HYSTPFTFGQGTKLEIKR |
| S4-6 VL | CDR-L1 Residues 24-34 of SEQ ID NO.: 69 | KASQLVSSAVA |
| S4-6 VL | CDR-L2 Residues 50-56 of SEQ ID NO.: 69 | WASTRHT |
| S4-6 VL | CDR-L3 Residues 89-97 of SEQ ID NO.: 69 | QQHYSTPFT |
| S4-55 VL | SEQ ID NO.: 70 | DIQMTQSPSSLSASVGDRVTITCKASQLVS SAVAWYQQKPGKAPKLLIYWASTLHTGVPS RFSGSGSGTDFTLTISSLQPEDFATYYCQQ HYRTPFTFGQGTKLEIKR |
| S4-55 VL | CDR-L1 Residues 24-34 of SEQ ID NO.: 70 | KASQLVSSAVA |
| S4-55 VL | CDR-L2 Residues 50-56 of SEQ ID NO.: 70 | WASTLHT |
| S4-55 VL | CDR-L3 Residues 89-97 of SEQ ID NO.: 70 | QQHYRTPFT |
| S4-63 VL | SEQ ID NO.: 71 | DIQMTQSPSSLSASVGDRVTITCKASQKVS SALAWYQQKPGKAPKLLIYWASALHSGVPS RFSGSGSGTDFTLTISSLQPEDFATYYCQQ HYRPPFTFGQGTKLEIKR |

TABLE 7-continued

Humanized anti-TNF MAK-195 Ab VL sequences of
IgG converted clones

| Protein region | | Sequence<br>12345678901234567890123456 7890 |
|---|---|---|
| S4-63 VL | CDR-L1 Residues 24-34 of SEQ ID NO.: 71 | KASQKVSSALA |
| S4-63 VL | CDR-L2 Residues 50-56 of SEQ ID NO.: 71 | WASALHS |
| S4-63 VL | CDR-L3 Residues 89-97 of SEQ ID NO.: 71 | QQHYRPPFT |
| S4-50 VL | SEQ ID NO.: 72 | DIQMTQSPSSLSASVGDRVTITCKASQLVS SAVAWYQQKPGKAPKLLIYWASALHTGVPS RFSGSGSGTDFTLTISSLQPEDFATYYCQQ HYSSPYTFGQGTKLEIKR |
| S4-50 VL | CDR-L1 Residues 24-34 of SEQ ID NO.: 72 | KASQLVSSAVA |
| S4-50 VL | CDR-L2 Residues 50-56 of SEQ ID NO.: 72 | WASALHT |
| S4-50 VL | CDR-L3 Residues 89-97 of SEQ ID NO.: 72 | QQHYSSPYT |
| S4-19 VL | SEQ ID NO.: 73 | DIQMTQSPSSLSASVGDRVTITCKASQLVS SAVAWYQQKPGKAPKLLIYWASTLHTGVPS RFSGSGSGTDFTLTISSLQPEDFATYYCQQ HYRTPFTFGQGTKLEIKR |
| S4-19 VL | CDR-L1 Residues 24-34 of SEQ ID NO.: 73 | KASQLVSSAVA |
| S4-19 VL | CDR-L2 Residues 50-56 of SEQ ID NO.: 73 | WASTLHT |
| S4-19 VL | CDR-L3 Residues 89-97 of SEQ ID NO.: 73 | QQHYRTPFT |

C. Individual hMAK-199 Sequences from Converted Clones

Table 8 provides VH sequences of humanized anti-TNF MAK-199 converted clones as discussed in detail in Example 3.

TABLE 8

Humanized Anti-TNF MAK-199 Ab VH sequences of
IgG converted clones

| Protein region | | Sequence<br>12345678901234567890123456 7890 |
|---|---|---|
| J662M2S3 #10 VH | SEQ ID NO.: 74 | EVQLVQSGAEVKKPGASVKVSCKASGYTFA NYGIIWVRQAPGQGLEWMGWINTYTGKPTY AQKFQGRVTMTTDTSTSTAYMELSSLRSED TAVYYCARKLFTTMDVTDNAMDYWGQGTTV TVSS |
| J662M2S3# 10 VH | CDR-H1 Residues 31-35 of SEQ ID NO.: 74 | NYGII |
| J662M2S3# 10 VH | CDR-H2 Residues 50-66 of SEQ ID NO.: 74 | WINTYTGKPTYAQKFQG |
| J662M2S3# 10 VH | CDR-H3 Residues 99-112 of SEQ ID NO.: 74 | RASQDISQYLN |

TABLE 8-continued

Humanized Anti-TNF MAK-199 Ab VH sequences of IgG converted clones

| Protein region | | Sequence<br>123456789012345678901234567890 |
|---|---|---|
| J662M2S3# 13 VH | SEQ ID NO.: 75 | EVQLVQSGAEVKKPGASVKVSCKASGYTFNNYGIIWVRQAPGQGLEWMGWINTYTGKPTYAQKLQGRVTMTTDTSTSTAYMELSSLRSEDTAVYFCARKLFNTVDVTDNAMDYWGQGTTVTVSS |
| J662M2S3# 13 VH | CDR-H1 Residues 31-35 of SEQ ID NO.: 75 | NYGII |
| J662M2S3# 13 VH | CDR-H2 Residues 50-66 of SEQ ID NO.: 75 | WINTYTGKPTYAQKLQG |
| J662M2S3# 13 VH | CDR-H3 Residues 99-112 of SEQ ID NO.: 75 | KLFNTVDVTDNAMD |
| J662M2S3# 15 VH | SEQ ID NO.: 76 | EVQLVQSGAEVKKPGASVKVSCKASGYTFNNYGIIWVRQAPGQGLEWMGWINTYTGVPTYAQKFQGRVTMTTDTSTSTAYMELSSLRSEDTAVYYCARKLFNTVDVTDNAMDYWGQGTTVTVSS |
| J662M2S3# 15 VH | CDR-H1 Residues 31-35 of SEQ ID NO.: 76 | NYGII |
| J662M2S3# 15 VH | CDR-H2 Residues 50-66 of SEQ ID NO.: 76 | WINTYTGVPTYAQKFQG |
| J662M2S3# 15 VH | CDR-H3 Residues 99-112 of SEQ ID NO.: 76 | KLFNTVDVTDNAMD |
| J662M2S3# 16 VH | SEQ ID NO.: 77 | EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSS |
| J662M2S3# 16 VH | CDR-H1 Residues 31-35 of SEQ ID NO.: 77 | NYGII |
| J662M2S3# 16 VH | CDR-H2 Residues 50-66 of SEQ ID NO.: 77 | WINTYTGKPTYAQKFQG |
| J662M2S3# 16 VH | CDR-H3 Residues 99-112 of SEQ ID NO.: 77 | KLFNTVAVTDNAMD |
| J662M2S3# 21 VH | SEQ ID NO.: 78 | EVQLVQSGAEVKKPGASVKVSCKASGYTFRNYGIIWVRQAPGQGLEWMGWINTYTGKPTYAQKFQGRVTMTTDTSTSTAYMELSSLRSEDTAVYFCARKLFTTVDVTDNAMDYWGQGTTVTVSS |
| J662M2S3# 21 VH | CDR-H1 Residues 31-35 of SEQ ID NO.: 78 | NYGII |
| J662M2S3# 21 VH | CDR-H2 Residues 50-66 of SEQ ID NO.: 78 | WINTYTGKPTYAQKFQG |
| J662M2S3# 21 VH | CDR-H3 Residues 99-112 of SEQ ID NO.: 78 | KLFTTVDVTDNAMD |
| J662M2S3# 34 VH | SEQ ID NO.: 79 | EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFRNTVAVTDYAMDYWGQGTTVTVSS |
| J662M2S3# 34 VH | CDR-H1 Residues 31-35 of SEQ ID NO.: 79 | NYGIN |
| J662M2S3# 34 VH | CDR-H2 Residues 50-66 of SEQ ID NO.: 79 | WINTYTGKPTYAQKFQG |

TABLE 8-continued

Humanized Anti-TNF MAK-199 Ab VH sequences of IgG converted clones

| Protein region | | Sequence 12345678901234567890123456789 0 |
|---|---|---|
| J662M2S3# 34 VH | CDR-H3 Residues 99-112 of SEQ ID NO.: 79 | KFRNTVAVTDYAMD |
| J662M2S3# 36 VH | SEQ ID NO.: 80 | EVQLVQSGAEVKKPGASVKVSCKASGYTFRNYGITWVRQAPGQGLEWMGWINTYTGKPTYAQKFQGRVTMTTDTSTSTAYMELSSLRSEDTAVYFCARKLFTTMDVTDNAMDYWGQGTTVTVSS |
| J662M2S3# 36 VH | CDR-H1 Residues 31-35 of SEQ ID NO.: 80 | NYGIT |
| J662M2S3# 36 VH | CDR-H2 Residues 50-66 of SEQ ID NO.: 80 | WINTYTGKPTYAQKFQG |
| J662M2S3# 36 VH | CDR-H3 Residues 99-112 of SEQ ID NO.: 80 | KLFTTMDVTDNAMD |
| J662M2S3# 45 VH | SEQ ID NO.: 81 | EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS |
| J662M2S3# 45 VH | CDR-H1 Residues 31-35 of SEQ ID NO.: 81 | NYGII |
| J662M2S3# 45 VH | CDR-H2 Residues 50-66 of SEQ ID NO.: 81 | WINTYTGKPTYAQKFQG |
| J662M2S3# 45 VH | CDR-H3 Residues 99-112 of SEQ ID NO.: 81 | KLFTTMDVTDNAMD |
| J662M2S3# 58 VH | SEQ ID NO.: 82 | EVQLVQSGAEVKKPGASVKVSCKASGYTFSNYGINWVRQAPGQGLEWMGWINTYTGQPSYAQKFQGRVTMTTDTSTSTAYMELSSLRSEDTAVYYCARKLFKTEAVTDYAMDYWGQGTTVTVSS |
| J662M2S3# 58 VH | CDR-H1 Residues 31-35 of SEQ ID NO.: 82 | NYGIN |
| J662M2S3# 58 VH | CDR-H2 Residues 50-66 of SEQ ID NO.: 82 | WINTYTGQPSYAQKFQG |
| J662M2S3# 58 VH | CDR-H3 Residues 99-112 of SEQ ID NO.: 82 | KLFKTEAVTDYAMD |
| J662M2S3# 72 VH | SEQ ID NO.: 83 | EVQLVQSGAEVKKPGASVKVSCKASGYTFNNYGIIWVRQAPGQGLEWMGWINTYSGKPTYAQKFQGRVTMTTDTSTSTAYMELSSLRSEDTAVYFCARKLFTTMDVTDNAMDYWGQGTTVTVSS |
| J662M2S3# 72 VH | CDR-H1 Residues 31-35 of SEQ ID NO.: 83 | NYGII |
| J662M2S3# 72 VH | CDR-H2 Residues 50-66 of SEQ ID NO.: 83 | WINTYSGKPTYAQKFQG |
| J662M2S3# 72 VH | CDR-H3 Residues 99-112 of SEQ ID NO.: 83 | KLFTTMDVTDNAMD |

Table 9 provides VL sequences of humanized anti-TNF MAK-199 converted clones as discussed in detail in Example 3.

TABLE 9

Humanized Anti-TNF MAK-199 Ab VL sequences of IgG converted clones

| Protein region | | Sequence 12345678901234567890123456789 0 |
|---|---|---|
| J662M2S3#10 VL | SEQ ID NO.: 84 | DIQMTQSPSSLSASVGDRVTITCRASQDIS QYLNWYQQKPGKAPKLLIYYTSRLQSGVPS RFSGSGSGTDFTLTISSLQPEDFATYFCQQ GNTWPPTFGQGTKLEIK |
| J662M2S3#10 VL | CDR-L1 Residues 24-34 of SEQ ID NO.: 84 | RASQDISQYLN |
| J662M2S3#10 VL | CDR-L2 Residues 50-56 of SEQ ID NO.: 84 | YTSRLQS |
| J662M2S3#10 VL | CDR-L3 Residues 89-97 of SEQ ID NO.: 84 | QQGNTWPPT |
| J662M2S3#13 VL | SEQ ID NO.: 85 | DIQMTQSPSSLSASVGDRVTITCRASQDIS NYLNWYQQKPGKAPKLLIYYTSRLQSGVPS RFSGSGSGTDYTLTISSLQPEDFATYFCQQ GNSWPPTFGQGTKLEIK |
| J662M2S3#13 VL | CDR-L1 Residues 24-34 of SEQ ID NO.: 85 | RASQDISNYLN |
| J662M2S3#13 VL | CDR-L2 Residues 50-56 of SEQ ID NO.: 85 | YTSRLQS |
| J662M2S3#13 VL | CDR-L3 Residues 89-97 of SEQ ID NO.: 85 | QQGNSWPPT |
| J662M2S3#15 VL | SEQ ID NO.: 86 | DIQMTQSPSSLSASVGDRVTITCRASQDIY NYLNWYQQKPGKAPKLLIYYTSRLQSGVPS RFSGSGSGTDYTLTISSLQPEDFATYFCQQ GNTQPPTFGQGTKLEIK |
| J662M2S3#15 VL | CDR-L1 Residues 24-34 of SEQ ID NO.: 86 | RASQDIYNYLN |
| J662M2S3#15 VL | CDR-L2 Residues 50-56 of SEQ ID NO.: 86 | YTSRLQS |
| J662M2S3#15 VL | CDR-L3 Residues 89-97 of SEQ ID NO.: 86 | QQGNTQPPT |
| J662M2S3#16 VL | SEQ ID NO.: 87 | DIQMTQSPSSLSASVGDRVTITCRASQDIE NYLNWYQQKPGKAPKLLIYYTSRLQSGVPS RFSGSGSGTDFTLTISSLQPEDFATYFCQQ GNTQPPTFGQGTKLEIK |
| J662M2S3#16 VL | CDR-L1 Residues 24-34 of SEQ ID NO.: 87 | RASQDIENYLN |
| J662M2S3#16 VL | CDR-L2 Residues 50-56 of SEQ ID NO.: 87 | YTSRLQS |
| J662M2S3#16 VL | CDR-L3 Residues 89-97 of SEQ ID NO.: 87 | QQGNTQPPT |
| J662M2S3#21 VL | SEQ ID NO.: 88 | DIQMTQSPSSLSASVGDRVTITCRASQDIS NYLNWYQQKPGKAPKLLIYYTSRLQSGVPS RFSGSGSGTDYTLTISSLQPEDFATYFCQQ GNTWPPTFGQGTKLEIK |
| J662M2S3#21 VL | CDR-L1 Residues 24-34 of SEQ ID NO.: 88 | RASQDISNYLN |
| J662M2S3#21 VL | CDR-L2 Residues 50-56 of SEQ ID NO.: 88 | YTSRLQS |
| J662M2S3#21 VL | CDR-L3 Residues 89-97 of SEQ ID NO.: 88 | QQGNTWPPT |

TABLE 9-continued

Humanized Anti-TNF MAK-199 Ab VL sequences of IgG converted clones

| Protein region | | Sequence 12345678901234567890123456789 0 |
|---|---|---|
| J662M2S3#34 VL | SEQ ID NO.: 89 | DIQMTQSPSSLSASVGDRVTITCRASQDIY DVLNWYQQKPGKAPKLLIYYASRLQSGVPS RFSGSGSGTDFTLTISSLQPEDFATYYCQQ GITLPPTFGQGTKLEIK |
| J662M2S3#34 VL | CDR-L1 Residues 24-34 of SEQ ID NO.: 89 | RASQDIYDVLN |
| J662M2S3#34 VL | CDR-L2 Residues 50-56 of SEQ ID NO.: 89 | YASRLQS |
| J662M2S3#34 VL | CDR-L3 Residues 89-97 of SEQ ID NO.: 89 | QQGITLPPT |
| J662M2S3#36 VL | SEQ ID NO.: 90 | DIQMTQSPSSLSASVGDRVTITCRASQDIS NYLNWYQQKPGKAPKLLIYYTSRLQSGVPS RFSGSGSGTDYTLTISSLQPEDFATYFCQQ GNTWPPTFGQGTKLEIK |
| J662M2S3#36 VL | CDR-L1 Residues 24-34 of SEQ ID NO.: 90 | RASQDISNYLN |
| J662M2S3#36 VL | CDR-L2 Residues 50-56 of SEQ ID NO.: 90 | YTSRLQS |
| J662M2S3#36 VL | CDR-L3 Residues 89-97 of SEQ ID NO.: 90 | QQGNTWPPT |
| J662M2S3#45 VL | SEQ ID NO.: 91 | DIQMTQSPSSLSASVGDRVTITCRASQDIS QYLNWYQQKPGKAPKLLIYYTSRLQSGVPS RFSGSGSGTDFTLTISSLQPEDFATYFCQQ GNTWPPTFGQGTKLEIK |
| J662M2S3#45 VL | CDR-L1 Residues 24-34 of SEQ ID NO.: 91 | RASQDISQYLN |
| J662M2S3#45 VL | CDR-L2 Residues 50-56 of SEQ ID NO.: 91 | YTSRLQS |
| J662M2S3#45 VL | CDR-L3 Residues 89-97 of SEQ ID NO.: 91 | QQGNTWPPT |
| J662M2S3#58 VL | SEQ ID NO.: 92 | DIQMTQSPSSLSASVGDRVTITCRASQNIY NVLNWYQQKPGKAPKLLIYYASRLQSGVPS RFSGSGSGTDFTLTISSLQPEDFATYFCQQ GNTMPPTFGQGTKLEIK |
| J662M2S3#58 VL | CDR-L1 Residues 24-34 of SEQ ID NO.: 92 | RASQNIYNVLN |
| J662M2S3#58 VL | CDR-L2 Residues 50-56 of SEQ ID NO.: 92 | YASRLQS |
| J662M2S3#58 VL | CDR-L3 Residues 89-97 of SEQ ID NO.: 92 | QQGNTMPPT |
| J662M2S3#72 VL | SEQ ID NO.: 93 | DIQMTQSPSSLSASVGDRVTITCRASQDIS NFLNWYQQKPGKAPKLLIYYTSRLQSGVPS RFSGSGSGTDYTLTISSLQPEDFATYFCQQ GNTQPPTFGQGTKLEIK |
| J662M2S3#72 VL | CDR-L1 Residues 24-34 of SEQ ID NO.: 93 | RASQDISNFLN |
| J662M2S3#72 VL | CDR-L2 Residues 50-56 of SEQ ID NO.: 93 | YTSRLQS |
| J662M2S3#72 VL | CDR-L3 Residues 89-97 of SEQ ID NO.: 93 | QQGNTQPPT |

In an embodiment, the antigen binding domain comprises the VH region chosen from any one of SEQ ID NOs: 22, 24, 26, 28, 30, 32, 34-58, 74-83, 94-266, 478-486, 496-675, 738-762, 778-956, 1053-1062, 1073, 1075, and 1077, or one, two, or three CDRs therefrom. In another embodiment, the antigen binding domain comprises the VL region chosen from any one of SEQ ID NOs: 23, 25, 27, 29, 31, 33, 59-73, 84-93, 267-477, 487-495, 676-737, 763-777, 957-1052, 1063-1072, 1074, 1076, and 1078, or one, two, or three CDRs therefrom. In a particular embodiment, the antigen binding domain comprises a VH region and a VL region, for example, wherein the VH region comprises SEQ ID NOs: 22, 24, 26, 28, 30, 32, 34-58, 74-83, 94-266, 478-486, 496-675, 738-762, 778-956, 1053-1062, 1073, 1075, and 1077, or one, two, or three CDRs therefrom, and the VL region comprises SEQ ID NOs: 23, 25, 27, 29, 31, 33, 59-73, 84-93, 267-477, 487-495, 676-737, 763-777, 957-1052, 1063-1072, 1074, 1076, and 1078, or one, two, or three CDRs therefrom.

In an embodiment where the VH and/or the VL CDR sequences are provided above, the human acceptor framework comprises at least one amino acid sequence selected from: SEQ ID NOs: 6-21. In a particular embodiment, the human acceptor framework comprises an amino acid sequence selected from: SEQ IN NOs: 9, 10, 11, 12, 15, 16, 17, and 21. In another embodiment, the human acceptor framework comprises at least one framework region amino acid substitution, wherein the amino acid sequence of the framework is at least 65% identical to the sequence of the human acceptor framework and comprises at least 70 amino acid residues identical to the human acceptor framework. In another embodiment, the human acceptor framework comprises at least one framework region amino acid substitution at a key residue. The key residue selected from: a residue adjacent to a CDR; a glycosylation site residue; a rare residue; a residue capable of interacting with human TNF-α; a residue capable of interacting with a CDR; a canonical residue; a contact residue between heavy chain variable region and light chain variable region; a residue within a Vernier zone; and a residue in a region that overlaps between a Chothia-defined variable heavy chain CDR1 and a Kabat-defined first heavy chain framework. In an embodiment, the key residue is selected from: H1, H12, H24, H27, H29, H37, H48, H49, H67, H71, H73, H76, H78, L13, L43, L58, L70, and L80. In an embodiment, the VH mutation is selected from: Q1E, I12V, A24V, G27F, I29L, V29F F29L I37V, I48L, V48L, S49G, V67L, F67L, V71K, R71K, T73N, N76S, L78I, and F78I. In another embodiment, the VL mutation is selected from: V13L, A43S, I58V, E70D, and S80P. In an embodiment, the binding protein comprises two variable domains, wherein the two variable domains have amino acid sequences selected from: SEQ ID NOS: 22 and 23; 23 and 24; 24 and 25; 26 and 27; 28 and 29; 30 and 31; or 32 and 33.

III. Production of Binding Proteins and Binding Protein-Producing Cell Lines

In an embodiment, TNF-α binding proteins disclosed herein exhibit a high capacity to reduce or to neutralize TNF-α activity, e.g., as assessed by any one of several in vitro and in vivo assays known in the art. Alternatively, TNF-α binding proteins disclosed herein, also exhibit a high capacity to increase or agonize TNF-α activity.

In particular embodiments, the isolated binding protein, or antigen-binding portion thereof, binds human TNF-α, wherein the binding protein, or antigen-binding portion thereof, dissociates from human TNF-α with a $k_{off}$ rate constant of about 0.1 s$^{-1}$ or less, as determined by surface plasmon resonance, such as $1\times10^{-2}$ s$^{-1}$ or less, $1\times10^{-3}$ s$^{-1}$ or less, $1\times10^{-4}$ s$^{-1}$ or less, $1\times10^{-5}$ s$^{-1}$ or less and $1\times10^{-6}$ s$^{-1}$ or less; or which inhibits human TNF-α activity with an IC$_{50}$ of about $1\times10^{-6}$ M or less, such as $1\times10^{-7}$ M or less, $1\times10^{-8}$ M or less, $1\times10^{-9}$ M or less, $1\times10^{-10}$ M or less and $1\times10^{-11}$ M or less. In certain embodiments, the binding protein comprises a heavy chain constant region, such as an IgG1, IgG2, IgG3, IgG4, IgA, IgE, IgM or IgD constant region. In an embodiment, the heavy chain constant region is an IgG1 heavy chain constant region or an IgG4 heavy chain constant region. Furthermore, the binding protein can comprise a light chain constant region, either a kappa light chain constant region or a lambda light chain constant region. In another embodiment, the binding protein comprises a kappa light chain constant region. Alternatively, the binding protein portion can be, for example, a Fab fragment or a single chain Fv fragment.

Replacements of amino acid residues in the Fc portion to alter binding protein effector function are known in the art (See U.S. Pat. Nos. 5,648,260 and 5,624,821). The Fc portion of a binding protein mediates several important effector functions, e.g., cytokine induction, ADCC, phagocytosis, complement dependent cytotoxicity (CDC) and half-life/clearance rate of antibody and antigen-antibody complexes. In some cases these effector functions are desirable for therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one amino acid residue is replaced in the constant region of the binding protein, for example the Fc region of the binding protein, such that effector functions of the binding protein are altered.

One embodiment provides a labeled binding protein wherein an antibody or antibody portion disclosed herein is derivatized or linked to another functional molecule (e.g., another peptide or protein). For example, a labeled binding protein disclosed herein can be derived by functionally linking an antibody or antibody portion disclosed herein (by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate associate of the antibody or antibody portion with another molecule (such as a streptavidin core region or a polyhistidine tag).

Useful detectable agents with which an antibody or antibody portion disclosed herein may be derivatized include fluorescent compounds. Exemplary fluorescent detectable agents include fluorescein, fluorescein isothiocyanate, rhodamine, 5-dimethylamine-1-napthalenesulfonyl chloride, phycoerythrin and the like. An antibody may also be derivatized with detectable enzymes, such as alkaline phosphatase, horseradish peroxidase, glucose oxidase and the like. When an antibody is derivatized with a detectable enzyme, it is detected by adding additional reagents that the enzyme uses to produce a detectable reaction product. For example, when the detectable agent horseradish peroxidase is present, the addition of hydrogen peroxide and diaminobenzidine leads to a colored reaction product, which is detectable. An antibody may also be derivatized with biotin, and detected through indirect measurement of avidin or streptavidin binding.

Another embodiment of the disclosure provides a crystallized binding protein. In an embodiment, provided are crystals of whole TNF-α binding proteins and fragments thereof as disclosed herein, and formulations and compositions comprising such crystals. In one embodiment the crystallized binding protein has a greater half-life in vivo than the soluble counterpart of the binding protein. In another embodiment the binding protein retains biological activity after crystallization.

Crystallized binding protein disclosed herein may be produced according methods known in the art and as disclosed in PCT Publication WO 02/72636.

Another embodiment of the disclosure provides a glycosylated binding protein wherein the binding protein or antigen-binding portion thereof comprises one or more carbohydrate residues. Nascent in vivo protein production may undergo further processing, known as post-translational modification. In particular, sugar (glycosyl) residues may be added enzymatically, a process known as glycosylation. The resulting proteins bearing covalently linked oligosaccharide side chains are known as glycosylated proteins or glycoproteins. Protein glycosylation depends on the amino acid sequence of the protein of interest, as well as the host cell in which the protein is expressed. Different organisms may produce different glycosylation enzymes (e.g., glycosyltransferases and glycosidases), and have different substrates (nucleotide sugars) available. Due to such factors, protein glycosylation pattern, and composition of glycosyl residues, may differ depending on the host system in which the particular protein is expressed. Glycosyl residues useful in the disclosure may include, but are not limited to, glucose, galactose, mannose, fucose, n-acetylglucosamine and sialic acid. In an embodiment, the glycosylated binding protein comprises glycosyl residues such that the glycosylation pattern is human.

It is known to those skilled in the art that differing protein glycosylation may result in differing protein characteristics. For instance, the efficacy of a therapeutic protein produced in a microorganism host, such as yeast, and glycosylated utilizing the yeast endogenous pathway may be reduced compared to that of the same protein expressed in a mammalian cell, such as a CHO cell line. Such glycoproteins may also be immunogenic in humans and show reduced half-life in vivo after administration. Specific receptors in humans and other animals may recognize specific glycosyl residues and promote the rapid clearance of the protein from the bloodstream. Other adverse effects may include changes in protein folding, solubility, susceptibility to proteases, trafficking, transport, compartmentalization, secretion, recognition by other proteins or factors, antigenicity, or allergenicity. Accordingly, a practitioner may prefer a therapeutic protein with a specific composition and pattern of glycosylation, for example glycosylation composition and pattern identical, or at least similar, to that produced in human cells or in the species-specific cells of the intended subject animal.

Expressing glycosylated proteins different from that of a host cell may be achieved by genetically modifying the host cell to express heterologous glycosylation enzymes. Using techniques known in the art a practitioner may generate antibodies or antigen-binding portions thereof exhibiting human protein glycosylation. For example, yeast strains have been genetically modified to express non-naturally occurring glycosylation enzymes such that glycosylated proteins (glycoproteins) produced in these yeast strains exhibit protein glycosylation identical to that of animal cells, especially human cells (U.S. Pat. Nos. 7,449,308 and 7,029,872).

Further, it will be appreciated by one skilled in the art that a protein of interest may be expressed using a library of host cells genetically engineered to express various glycosylation enzymes, such that member host cells of the library produce the protein of interest with variant glycosylation patterns. A practitioner may then select and isolate the protein of interest with particular novel glycosylation patterns. In an embodiment, the protein having a particularly selected novel glycosylation pattern exhibits improved or altered biological properties.

IV. Uses of TNF-α Binding Proteins

Given their ability to bind to human TNF-α, e.g., the human TNF-α binding proteins, or portions thereof, disclosed herein can be used to detect TNF-α (e.g., in a biological sample, such as serum or plasma), using a conventional immunoassay, such as an enzyme linked immunosorbent assays (ELISA), an radioimmunoassay (RIA) or tissue immunohistochemistry. A method for detecting TNF-α in a biological sample is provided comprising contacting a biological sample with a binding protein, or binding protein portion, disclosed herein and detecting either the binding protein (or binding protein portion) bound to TNF-α or unbound binding protein (or binding protein portion), to thereby detect TNF-α in the biological sample. The binding protein is directly or indirectly labeled with a detectable substance to facilitate detection of the bound or unbound antibody. Suitable detectable substances include various enzymes, prosthetic groups, fluorescent materials, luminescent materials and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; and examples of suitable radioactive material include $^3$H, $^{14}$C, $^{35}$S, $^{90}$Y, $^{99}$Tc, $^{111}$In, $^{125}$I, $^{131}$I, $^{177}$Lu, $^{166}$Ho, or $^{153}$Sm.

Alternative to labeling the binding protein, human TNF-α can be assayed in biological fluids by a competition immunoassay utilizing rhTNF-α standards labeled with a detectable substance and an unlabeled human TNF-α binding protein. In this assay, the biological sample, the labeled rhTNF-α standards and the human TNF-α binding protein are combined and the amount of labeled rhTNF-α standard bound to the unlabeled binding protein is determined. The amount of human TNF-α in the biological sample is inversely proportional to the amount of labeled rhTNF-α standard bound to the TNF-α binding protein. Similarly, human TNF-α can also be assayed in biological fluids by a competition immunoassay utilizing rhTNF-α standards labeled with a detectable substance and an unlabeled human TNF-α binding protein.

In an embodiment, the binding proteins and binding protein portions disclosed herein are capable of neutralizing TNF-α activity, e.g., human TNF-α activity, both in vitro and in vivo. In another embodiment, the binding proteins and binding protein portions disclosed herein are capable of increasing or agonizing human TNF-α activity, e.g., human TNF-α activity. Accordingly, such binding proteins and binding protein portions disclosed herein can be used to inhibit or increase hTNF-α activity, e.g., in a cell culture containing hTNF-α, in human subjects or in other mammalian subjects having TNF-α with which a binding protein disclosed herein cross-reacts. In one embodiment, a method for inhibiting or increasing hTNF-α activity is provided comprising contacting hTNF-α with a binding protein or binding protein portion disclosed herein such that hTNF-α activity is inhibited or increased. For example, in a cell culture containing, or suspected of containing hTNF-α, a binding protein or binding protein portion disclosed herein can be added to the culture medium to inhibit or increase hTNF-α activity in the culture.

In another embodiment, a method is provided for reducing or increasing hTNF-α activity in a subject, advantageously from a subject suffering from a disease or disorder in which TNF-α-activity is detrimental or, alternatively, beneficial. Methods for reducing or increasing TNF-α activity in a subject suffering from such a disease or disorder is provided, which method comprises administering to the subject a binding protein or binding protein portion disclosed herein such that TNF-α activity in the subject is reduced or increased. In a particular embodiment, the TNF-α is human TNF-α, and the subject is a human subject. Alternatively, the subject can be a mammal expressing a TNF-α to which a binding protein provided is capable of binding. Still further the subject can be a mammal into which TNF-α has been introduced (e.g., by administration of TNF-α or by expression of a TNF-α transgene). A binding protein disclosed herein can be administered to a human subject for therapeutic purposes. Moreover, a binding protein disclosed herein can be administered to a non-human mammal expressing a TNF-α with which the binding protein is capable of binding for veterinary purposes or as an animal model of human disease. Regarding the latter, such animal models may be useful for evaluating the therapeutic efficacy of binding proteins disclosed herein (e.g., testing of dosages and time courses of administration).

The term "a disorder in which TNF-α activity is detrimental" includes diseases and other disorders in which the presence of TNF-α activity in a subject suffering from the disorder has been shown to be or is suspected of being either responsible for the pathophysiology of the disorder or a factor that contributes to a worsening of the disorder. Accordingly, a disorder in which TNF-α activity is detrimental is a disorder in which reduction of TNF-α activity is expected to alleviate the symptoms and/or progression of the disorder. Such disorders may be evidenced, for example, by an increase in the concentration of TNF-α in a biological fluid of a subject suffering from the disorder (e.g., an increase in the concentration of TNF-α in serum, plasma, synovial fluid, etc. of the subject), which can be detected, for example, using an anti-TNF-α antibody as described above. Non-limiting examples of disorders that can be treated with the binding proteins disclosed herein include those disorders discussed in the section below pertaining to pharmaceutical compositions of the antibodies disclosed herein.

Alternatively, the term "a disorder in which TNF-α activity is beneficial" include diseases and other disorders in which the presence of TNF-α activity in a subject suffering from the disorder has been shown to be or is suspected of being either beneficial for treating the pathophysiology of the disorder or a factor that contributes to a treatment of the disorder. Accordingly, a disorder in which TNF-α activity is beneficial is a disorder in which an increase of TNF-α activity is expected to alleviate the symptoms and/or progression of the disorder. Non-limiting examples of disorders that can be treated with the antibodies disclosed herein include those disorders discussed in the section below pertaining to pharmaceutical compositions of the antibodies disclosed herein.

V. Pharmaceutical Compositions

Pharmaceutical compositions are also provided comprising a binding protein, or antigen-binding portion thereof, disclosed herein and a pharmaceutically acceptable carrier. The pharmaceutical compositions comprising binding protein disclosed herein are for use in, but not limited to, diagnosing, detecting, or monitoring a disorder, in preventing, treating, managing, or ameliorating of a disorder or one or more symptoms thereof, and/or in research. In a specific embodiment, a composition comprises one or more binding proteins disclosed herein. In another embodiment, the pharmaceutical composition comprises one or more binding proteins disclosed herein and one or more prophylactic or therapeutic agents other than binding proteins disclosed herein for treating a disorder in which TNF-α activity is detrimental. In a particular embodiment, the prophylactic or therapeutic agents known to be useful for or having been or currently being used in the prevention, treatment, management, or amelioration of a disorder or one or more symptoms thereof. In accordance with these embodiments, the composition may further comprise of a carrier, diluent or excipient.

The binding proteins and binding protein-portions disclosed herein can be incorporated into pharmaceutical compositions suitable for administration to a subject. Typically, the pharmaceutical composition comprises a binding protein or binding protein portion disclosed herein and a pharmaceutically acceptable carrier. The term "pharmaceutically acceptable carrier" includes any and all solvents, dispersion media, coatings, antibacterial and antifungal agents, isotonic and absorption delaying agents, and the like that are physiologically compatible. Examples of pharmaceutically acceptable carriers include one or more of water, saline, phosphate buffered saline, dextrose, glycerol, ethanol and the like, as well as combinations thereof. In many cases, isotonic agents, for example, sugars, polyalcohols such as mannitol, sorbitol, or sodium chloride in the composition, may be included. Pharmaceutically acceptable carriers may further comprise minor amounts of auxiliary substances such as wetting or emulsifying agents, preservatives or buffers, which enhance the shelf life or effectiveness of the binding protein or binding protein portion.

Various delivery systems are known and can be used to administer one or more binding proteins disclosed herein or the combination of one or more binding proteins disclosed herein and a prophylactic agent or therapeutic agent useful for preventing, managing, treating, or ameliorating a disorder or one or more symptoms thereof, e.g., encapsulation in liposomes, microparticles, microcapsules, recombinant cells capable of expressing the binding protein or binding protein fragment, receptor-mediated endocytosis (see, e. g., Wu and Wu (1987) *J. Biol. Chem.* 262:4429-4432), construction of a nucleic acid as part of a retroviral or other vector, etc. Methods of administering a prophylactic or therapeutic agent disclosed herein include, but are not limited to, parenteral administration (e.g., intradermal, intramuscular, intraperitoneal, intravenous and subcutaneous), epidural administration, intratumoral administration, and mucosal administration (e.g., intranasal and oral routes). In addition, pulmonary administration can be employed, e.g., by use of an inhaler or nebulizer, and formulation with an aerosolizing agent. In one embodiment, a binding protein disclosed herein, combination therapy, or a composition disclosed herein is administered using Alkermes AIR® pulmonary drug delivery technology (Alkermes, Inc., Cambridge, Mass.). In a specific embodiment, prophylactic or therapeutic agents disclosed herein are administered intramuscularly, intravenously, intratumorally, orally, intranasally, pulmonary, or subcutaneously. The prophylactic or therapeutic agents may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

In a specific embodiment, it may be desirable to administer the prophylactic or therapeutic agents disclosed herein locally to the area in need of treatment; this may be achieved by, for example, and not by way of limitation, local infusion, by injection, or by means of an implant, said implant being of a porous or non-porous material, including membranes and matrices, such as sialastic membranes, polymers, fibrous matrices (e.g., Tissuel®), or collagen matrices. In one embodiment, an effective amount of one or more binding proteins disclosed herein antagonists is administered locally to the affected area to a subject to prevent, treat, manage, and/or ameliorate a disorder or a symptom thereof. In another embodiment, an effective amount of one or more binding proteins disclosed herein is administered locally to the affected area in combination with an effective amount of one or more therapies (e.g., one or more prophylactic or therapeutic agents) other than an antibody disclosed herein of a subject to prevent, treat, manage, and/or ameliorate a disorder or one or more symptoms thereof.

In a specific embodiment, where the composition disclosed herein is a nucleic acid encoding a prophylactic or therapeutic agent, the nucleic acid can be administered in vivo to promote expression of its encoded prophylactic or therapeutic agent, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, DuPont), or coating with lipids or cell-surface receptors or transfecting agents, or by administering it in linkage to a homeobox-like peptide which is known to enter the nucleus (see, e.g., Joliot et al. (1991) *Proc. Natl. Acad. Sci. USA* 88:1864-1868). Alternatively, a nucleic acid can be introduced intracellularly and incorporated within host cell DNA for expression by homologous recombination.

The method disclosed herein may comprise administration of a composition formulated for parenteral administration by injection (e.g., by bolus injection or continuous infusion). Formulations for injection may be presented in unit dosage form (e.g., in ampoules or in multi-dose containers) with an added preservative. The compositions may take such forms as suspensions, solutions or emulsions in oily or aqueous vehicles, and may contain formulatory agents such as suspending, stabilizing and/or dispersing agents. Alternatively, the active ingredient may be in powder form for constitution with a suitable vehicle (e.g., sterile pyrogen-free water) before use.

The methods disclosed herein may additionally comprise of administration of compositions formulated as depot preparations. Such long acting formulations may be administered by implantation (e.g., subcutaneously or intramuscularly) or by intramuscular injection. Thus, for example, the compositions may be formulated with suitable polymeric or hydrophobic materials (e.g., as an emulsion in an acceptable oil) or ion exchange resins, or as sparingly soluble derivatives (e.g., as a sparingly soluble salt).

The methods disclosed herein encompass administration of compositions formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

Generally, the ingredients of compositions are supplied either separately or mixed together in unit dosage form, for example, as a dry lyophilized powder or water free concentrate in a hermetically sealed container such as an ampoule or sachette indicating the quantity of active agent. Where the mode of administration is infusion, composition can be dispensed with an infusion bottle containing sterile pharmaceutical grade water or saline. Where the mode of administration is by injection, an ampoule of sterile water for injection or saline can be provided so that the ingredients may be mixed prior to administration.

In particular, it is also provided that one or more of the prophylactic or therapeutic agents, or pharmaceutical compositions disclosed herein is packaged in a hermetically sealed container such as an ampoule or sachette indicating the quantity of the agent. In one embodiment, one or more of the prophylactic or therapeutic agents, or pharmaceutical compositions disclosed herein is supplied as a dry sterilized lyophilized powder or water free concentrate in a hermetically sealed container and can be reconstituted (e.g., with water or saline) to the appropriate concentration for administration to a subject. In an embodiment, one or more of the prophylactic or therapeutic agents or pharmaceutical compositions disclosed herein is supplied as a dry sterile lyophilized powder in a hermetically sealed container at a unit dosage of at least 5 mg, at least 10 mg, at least 15 mg, at least 25 mg, at least 35 mg, at least 45 mg, at least 50 mg, at least 75 mg, or at least 100 mg. The lyophilized prophylactic or therapeutic agents or pharmaceutical compositions disclosed herein should be stored at between 2° C. and 8° C. in its original container and the prophylactic or therapeutic agents, or pharmaceutical compositions disclosed herein should be administered within 1 week, within 5 days, within 72 hours, within 48 hours, within 24 hours, within 12 hours, within 6 hours, within 5 hours, within 3 hours, or within 1 hour after being reconstituted. In an alternative embodiment, one or more of the prophylactic or therapeutic agents or pharmaceutical compositions disclosed herein is supplied in liquid form in a hermetically sealed container indicating the quantity and concentration of the agent. In an embodiment, the liquid form of the administered composition is supplied in a hermetically sealed container at least 0.25 mg/ml, at least 0.5 mg/ml, at least 1 mg/ml, at least 2.5 mg/ml, at least 5 mg/ml, at least 8 mg/ml, at least 10 mg/ml, at least 15 mg/kg, at least 25 mg/ml, at least 50 mg/ml, at least 75 mg/ml or at least 100 mg/ml. The liquid form should be stored at between 2° C. and 8° C. in its original container.

The binding proteins and binding protein-portions disclosed herein can be incorporated into a pharmaceutical composition suitable for parenteral administration. In an embodiment, the binding protein or binding protein-portions will be prepared as an injectable solution containing 0.1-250 mg/ml binding protein. The injectable solution can be composed of either a liquid or lyophilized dosage form in a flint or amber vial, ampoule or pre-filled syringe. The buffer can be L-histidine (1-50 mM), optimally 5-10 mM, at pH 5.0 to 7.0 (optimally pH 6.0). Other suitable buffers include but are not limited to, sodium succinate, sodium citrate, sodium phosphate or potassium phosphate. Sodium chloride can be used to modify the toxicity of the solution at a concentration of 0-300 mM (optimally 150 mM for a liquid dosage form). Cryoprotectants can be included for a lyophilized dosage form, principally 0-10% sucrose (optimally 0.5-1.0%). Other suitable cryoprotectants include trehalose and lactose. Bulking agents can be included for a lyophilized dosage form, principally 1-10% mannitol (optimally 2-4%). Stabilizers can be used in both liquid and lyophilized dosage forms, principally 1-50 mM L-Methionine (optimally 5-10 mM). Other suitable bulking agents include glycine, arginine, can be included as 0-0.05% polysorbate-80 (optimally 0.005-0.01%). Additional surfactants include but are not limited to polysorbate 20 and BRIJ surfactants.

Typical compositions are in the form of injectable or infusible solutions, such as compositions similar to those used for passive immunization of humans with other antibodies. Therapeutic compositions typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the active compound (i.e., binding protein or binding protein portion) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile, lyophilized powders for the preparation of sterile injectable solutions, the methods of preparation include vacuum drying and spray-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including, in the composition, an agent that delays absorption, for example, monostearate salts and gelatin.

As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., Sustained and Controlled Release Drug Delivery Systems, J. R. Robinson, ed., Marcel Dekker, Inc., New York, 1978.

Supplementary active compounds can also be incorporated into the compositions. In certain embodiments, a binding protein or binding protein portion disclosed herein is coformulated with and/or coadministered with one or more additional therapeutic agents that are useful for treating disorders in which TNF-α activity is detrimental. For example, an anti-hTNF-α antibody or antibody portion disclosed herein may be coformulated and/or coadministered with one or more additional antibodies that bind other targets (e.g., antibodies that bind other cytokines or that bind cell surface molecules). Furthermore, one or more binding proteins disclosed herein may be used in combination with two or more of the foregoing therapeutic agents. Such combination therapies may advantageously utilize lower dosages of the administered therapeutic agents, thus avoiding possible toxicities or complications associated with the various monotherapies.

In certain embodiments, a binding protein to TNF-α or fragment thereof is linked to a half-life extending vehicle known in the art. Such vehicles include, but are not limited to, the Fc domain, polyethylene glycol, and dextran. Such vehicles are described, e.g., in U.S. Pat. No. 6,660,843.

In a specific embodiment, nucleic acid sequences comprising nucleotide sequences encoding a binding protein disclosed herein or another prophylactic or therapeutic agent disclosed herein are administered to treat, prevent, manage, or ameliorate a disorder or one or more symptoms thereof by way of gene therapy. Gene therapy refers to therapy performed by the administration to a subject of an expressed or expressible nucleic acid. In this embodiment of the disclosure, the nucleic acids produce their encoded binding protein or prophylactic or therapeutic agent disclosed herein that mediates a prophylactic or therapeutic effect.

Any of the methods for gene therapy available in the art can be used according to the present disclosure.

TNF-α plays a critical role in the pathology associated with a variety of diseases involving immune and inflammatory elements, such as autoimmune diseases, particularly those assocated with inflammation, including Crohn's disease, psoriasis (including plaque psoriasis), arthritis (including rheumatoid arthritis, psoratic arthritis, osteoarthritis, or juvenile idiopathic arthritis), multiple sclerosis, systemic lupus erythematosus, and ankylosing spondylitis. Therefore, the binding proteins herein may be used to treat these disorders. In another embodiment, the disorder is a respiratory disorder; asthma; allergic and nonallergic asthma; asthma due to infection; asthma due to infection with respiratory syncytial virus (RSV); chronic obstructive pulmonary disease (COPD); a condition involving airway inflammation; eosinophilia; fibrosis and excess mucus production; cystic fibrosis; pulmonary fibrosis; an atopic disorder; atopic dermatitis; urticaria; eczema; allergic rhinitis; allergic enterogastritis; an inflammatory and/or autoimmune condition of the skin; an inflammatory and/or autoimmune condition of gastrointestinal organs; inflammatory bowel diseases (IBD); ulcerative colitis; an inflammatory and/or autoimmune condition of the liver; liver cirrhosis; liver fibrosis; liver fibrosis caused by hepatitis B and/or C virus; scleroderma; tumors or cancers; hepatocellular carcinoma; glioblastoma; lymphoma; Hodgkin's lymphoma; a viral infection; a bacterial infection; a parasitic infection; HTLV-1 infection; suppression of expression of protective type 1 immune responses, suppression of expression of a protective type 1 immune response during vaccination, neurodegenerative diseases, neuronal regeneration, and spinal cord injury.

It will be readily apparent to those skilled in the art that other suitable modifications and adaptations of the methods disclosed herein may be made using suitable equivalents without departing from the scope of the invention or the embodiments disclosed herein. Having now described the present disclosure in detail, the same will be more clearly understood by reference to the following examples, which are included for purposes of illustration only and are not intended to be limiting of the invention.

EXAMPLES

Example 1: Identification of Fully Human Antibodies to TNF by in Vitro Display Systems 1.1: Antibody Selections Fully human anti-human TNF monoclonal antibodies were isolated by in vitro display technologies from human antibody libraries by their ability to bind recombinant human TNF proteins. The amino acid sequences of the variable heavy (VH) and variable light (VL) chains were determined from DNA sequencing and listed in Table 10.

TABLE 10

| | | | Sequence |
|---|---|---|---|
| Protein region | | SEQ ID NO: | 12345678901234567890123456 7890 |
| AE11-1 VH | | 22 | EVQLVQSGAEVKKPGASVKVSCKASGYTFTSYDVNWVRQATGQGLEWMGMNPNSGNTGYAQKFQGRVTITADESTSTAYMELSSLRSEDTAVYYCAIFDSDYMDVWGKGTLVTVSS |
| AE11-1 VH | CDR-H1 | Residues 31-35 of SEQ ID NO.: 22 | SYDVN |
| AE11-1 VH | CDR-H2 | Residues 50-66 of SEQ ID NO.: 22 | WMNPNSGNTGYAQKFQG |
| AE11-1 VH | CDR-H3 | Residues 99-106 of SEQ ID NO.: 22 | FDSDYMDV |
| AE11-1 VL | | 23 | SYELTQPPSVSLSPGQTARITCSGDALPKQYAYWYQQKPGQAPVLVIYKDTERPSGIPERFSGSSSGTTVTLTISGAQAEDEADYYCQSADSSGTSWVFGGGTKLTVL |
| AE11-1 VL | CDR-L1 | Residues 23-33 of SEQ ID NO.: 23 | SGDALPKQYAY |
| AE11-1 VL | CDR-L2 | Residues 49-55 of SEQ ID NO.: 23 | KDTERPS |
| AE11-1 VL | CDR-L3 | Residues 89-98 of SEQ ID NO.: 23 | SADSSGTSWV |
| AE11-5 VH | | 24 | EVQLVQSGAEVKKPGSSAKVSCKASGGTFSSYAISWVRQAPGQGLEWMGGIIPILGTANYAQKFLGRVTITADESTSTVYMELSSLRSEDTAVYYCARGLYYDPTRADYWGQGTLVTVSS |
| AE11-5 VH | CDR-H1 | Residues 31-35 of SEQ ID NO.: 24 | SYAIS |
| AE11-5 VH | CDR-H2 | Residues 50-66 of SEQ ID NO.: 24 | GIIPILGTANYAQKFLG |
| AE11-5 VH | CDR-H3 | Residues 99-109 of SEQ ID NO.: 24 | GLYYDPTRADY |
| AE11-5 VL | | 25 | DIVMTQSPDFHSVTPKEKVTITCRASQSIGSSLHWYQQKPDQSPKLLIRHASQSISGVPSRFSGSGSGTDFTLTIHSLEAEDAATYYCHQSSSSPPPTFGQGTQVEIK |
| AE11-5 VL | CDR-L1 | Residues 24-34 of SEQ ID NO.: 25 | RASQSIGSSLH |
| AE11-5 VL | CDR-L2 | Residues 50-56 of SEQ ID NO.: 25 | HASQSIS |
| AE11-5 VL | CDR-L3 | Residues 89-98 of SEQ ID NO.: 25 | HQSSSSPPPT |
| TNF-JK1 VH | | 26 | EVQLVESGGGLVQPGGSLRLSCATSGFTFNNYWMSWVRQAPGKGLEWVANINHDESEKYYVDSAKGRFTISRDNAEKSLFLQMNSLRAEDTAVYYCARIIRGRVGFDYYNYAMDVWGQGTLVTVSS |
| TNF-JK1 VH | CDR-H1 | Residues 31-35 of SEQ ID NO.: 26 | NYWMS |
| TNF-JK1 VH | CDR-H2 | Residues 50-66 of SEQ ID NO.: 26 | NINHDESEKYYVDSAKG |
| TNF-JK1 VH | CDR-H3 | Residues 99-115 of SEQ ID NO.: 26 | IIRGRVGFDYYNYAMDV |
| TNF-JK1 VL | | 27 | DIRLTQSPSPLSASVGDRVTITCRASQSIGNYLNWYQHKPGKAPKLLIYAASSLQSGVPSRFSGTGSGTDFTLTISSLQPEDFATYYCQESYSLIFAGGTKVEIK |

TABLE 10-continued

Individual clones sequences

| Protein region | | SEQ ID NO: | Sequence<br>12345678901234567890123456789 0 |
|---|---|---|---|
| TNF-JK1 VL | CDR-L1 | Residues 24-34 of SEQ ID NO.: 27 | RASQSIGNYLN |
| TNF-JK1 VL | CDR-L2 | Residues 50-56 of SEQ ID NO.: 27 | AASSLQS |
| TNF-JK1 VL | CDR-L3 | Residues 89-95 of SEQ ID NO.: 27 | QESYSLI |
| TNF-Y7C VH | | 28 | EVQLVQSGAEVKKPGASVKVSCKTSGYTFSNYDINWVRQPTGQLEWMGWMDPNNGNTGYAQKFVGRVTMTRDTSKTTAYLELSGLKSEDTAVYYCARSSGSGGTWYKEYFQSWGQGTMVTVSS |
| TNF-Y7C VH | CDR-H1 | Residues 31-35 of SEQ ID NO.: 28 | NYDIN |
| TNF-Y7C VH | CDR-H2 | Residues 50-66 of SEQ ID NO.: 28 | WMDPNNGNTGYAQKFVG |
| TNF-Y7C VH | CDR-H3 | Residues 99-112 of SEQ ID NO.: 28 | KSSGSGGTWYKEYFQS |
| TNF-Y7C VL | | 29 | DIVMTQSPLSLPVTPGEPASISCRSSQSLLHSNGYNYLDWYLQKPGQFPQLLIYLGSYRASGVPDRFSGSGSGTDFTLKISRVEAEDVGVYYCMQRIEFPPGTFGQGTKLGIK |
| TNF-Y7C VL | CDR-L1 | Residues 24-39 of SEQ ID NO.: 29 | RSSQSLLHSNGYNYLD |
| TNF-Y7C VL | CDR-L2 | Residues 55-61 of SEQ ID NO.: 29 | LGSYRAS |
| TNF-Y7C VL | CDR-L3 | Residues 94-103 of SEQ ID NO.: 29 | MQRIEFPPGT |
| AE11-7 VH | | 30 | EVQLVQSGAEVKKPGASVKVSCKTSGYSLTQYPIHWVRQAPGQRPEWMGWISPGNGNTKLSPKFQGRVTLSRDASAGTVFMDLSGLTSDDTAVYFCTSVDLGDHWGQGTLVTVSS |
| AE11-7 VH | CDR-H1 | Residues 31-35 of SEQ ID NO.: 30 | QYPIH |
| AE11-7 VH | CDR-H2 | Residues 50-66 of SEQ ID NO.: 30 | WISPGNGNTKLSPKFQG |
| AE11-7 VH | CDR-H3 | Residues 99-104 of SEQ ID NO.: 30 | VDLGDH |
| AE11-7 VL | | 31 | DIVMTQSPEFQSVTPKEKVTITCRASQSIGSSLHWYQQKPDQSPKLLINYASQSFSGVPSRFSGGGSGTDFTLTINSLEAEDAATYYCHQSSNLPITFGQGTRLEIK |
| AE11-7 VL | CDR-L1 | Residues 24-34 of SEQ ID NO.: 31 | RASQSIGSSLH |
| AE11-7 VL | CDR-L2 | Residues 50-56 of SEQ ID NO.: 31 | YASQSFS |
| AE11-7 VL | CDR-L3 | Residues 89-97 of SEQ ID NO.: 31 | HQSSNLPIT |
| AE11-13 VH | | 32 | EVQLVESGGGLVQPGRSLRLSCAASGFTFDDYPMHWVRQAPGEGLEWVSGISSNSASIGYADSVKGRFTISRDNAQNTLYLQMNSLGDEDTAVYYCVSLTLGIGQGTLVTVSS |
| AE11-13 VH | CDR-H1 | Residues 31-35 of SEQ ID NO.: 32 | DYPMH |

TABLE 10-continued

Individual clones sequences

| Protein region | SEQ ID NO: | Sequence<br>12345678901234567890123456789 0 |
|---|---|---|
| AE11-13 VH CDR-H2 | Residues 50-66 of SEQ ID NO.: 32 | GISSNSASIGYADSVKG |
| AE11-13 VH CDR-H3 | Residues 99-102 of SEQ ID NO.: 32 | LTLG |
| AE11-13 VL | 33 | DIRLTQSPSSLSASVGDRVTITCRASQSIG NYLHWYQQKPGKAPKLLIYAASSLQSGVPS RFSGSGSGTDFTLTISSLQPEDFATYYCQQ SYSTLYSFGQGTKLEIK |
| AE11-13 VL CDR-L1 | Residues 24-34 of SEQ ID NO.: 33 | RASQSIGNYLH |
| AE11-13 VL CDR-L2 | Residues 50-56 of SEQ ID NO.: 33 | AASSLQS |
| AE11-13 VL CDR-L3 | Residues 89-97 of SEQ ID NO.: 33 | QQSYSTLYS |

1.2: Affinity Maturation of the Fully Human Anti-Human TNF Antibody AE11-5

The AE11-5 human antibody to human TNF was affinity matured by in vitro display technology. One light chain library was constructed to contain limited mutagenesis at the following residues: 28, 31, 32, 51, 55, 91, 92, 93, 95a and 96 (Kabat numbering). This library also contained framework germline back-mutations D1E, M4L, H11Q, R49K, H76N and Q103K as well as toggled residues at position 50(R/K) and 94(S/L) to allow for framework germlining during library selections. Two heavy chain libraries were made to contain limited mutagenesis in CDRH1 and CDRH2 at residues 30, 31, 33, 50, 52, and 55 to 58 (Kabat numbering) or in CDRH3 at residues 95 to 100b. The library containing CDRH1 and CDRH2 diversities also had framework germline back-mutations A18V and L64Q and toggled residue at 54(L/F) and 78(V/A). The CDRH3 library has an additional toggled residue at 100c(A/F).

All three libraries were selected separately for the ability to bind human or cynomolgus monkey TNF in the presence of decreasing concentrations of biotinylated human or cynomolgus monkey TNF antigens. All mutated CDR sequences recovered from library selections were recombined into additional libraries and the recombined libraries were subjected to more stringent selection conditions before individual antibodies are identified.

Table 11 provides a list of amino acid sequences of VH regions of affinity matured fully human TNF antibodies derived from AE11-5. Amino acid residues of individual CDRs of each VH sequence are indicated in bold.

TABLE 11

List of amino acid sequences of affinity matured AE11-5 VH variants

| Clone | SEQ ID NO: | VH |
|---|---|---|
| J685M2S2-10VH | 94 | EVQLVQSGAEVKKPGSSVKVSCKASGGTFSWYA ISWVRQAPGQGLEWMGGITPILGSANYAQKFQG RVTITADESTSTAYMELSSLRSEDTAVYYCARG LYYDPTRADYWGQGTLVTVSS |
| J685M2S2-12VH | 95 | EVQLVQSGAEVKKPGSSVKVSCKASGGTFSYYS ISWVRQAPGQGLEWMGGIMPILGTANYAQKFQG RVTITADESTSTAYMELSSLRSEDTAVYYCARG LYYDPTRADYWGQGTLVTVSS |
| J685M2S2-13VH | 96 | EVQLVQSGAEVKKPGSSVKVSCKASGGTFSWYA ISWVRQAPGQGLEWMGGIIPILGSPIYAQKFQG RVTITADESTSTAYMELSSLRSEDTAVYYCARG LYYDPTRADYWGQGTLVTVSS |
| J685M2S2-14VH | 97 | EVQLVQSGAEVKKPGSSVKVSCKASGGTFSWYT ISWVRQAPGQGLEWMGGIIPILGSPIYAQKFQG RVTITADESTSTAYMELSSLRSEDTAVYYCARG LYYDPTRADYWGQGTLVTVSS |
| J685M2S2-16VH | 98 | EVQLVQSGAEVKKPGSSVKVSCKASGGTFAWYS ISWVRQAPGQGLEWMGGITPILGTANYAQKFQG RVTITADESTSTAYMELSSLRSEDTAVYYCARG LYYDPTRADYWGQGTLVTVSS |

TABLE 11-continued

List of amino acid sequences of affinity matured AE11-5 VH variants

| Clone | SEQ ID NO: | VH |
|---|---|---|
| J685M2S2-18VH | 99 | EVQLVQSGAEVKKPGSSVKVSCKASGGTFSFYA<br>ISWVRQAPGQGLEWMGGITPILGAATYAQKFQG<br>RVTITADESTSTAYMELSSLRSEDTAVYYCARG<br>LYYDPTRADYWGQGTLVTVSS |
| J685M2S2-1VH | 100 | EVQLVQSGAEVKKPGSSVKVSCKASGGTFSIYA<br>ISWVRQAPGQGLEWMGGITPILGAAVYAQKFQG<br>RVTITADESTSTAYMELSSLRSEDTAVYYCARG<br>LYYDPTRADYWGQGTLVTVSS |
| J685M2S2-21VH | 101 | EVQLVQSGAEVKKPGSSVKVSCKASGGTFSWYT<br>ISWVRQAPGQGLEWMGGIMPILGTANYAQKFQG<br>RVTITADESTSTAYMELSSLRSEDTAVYYCARG<br>LYYDPTRADYWGQGTLVTVSS |
| J685M2S2-23VH | 102 | EVQLVQSGAEVKKPGSSVKVSCKASGGTFSWYA<br>ISWVRQAPGQGLEWMGGITPILGVAVYAQKFQG<br>RVTITADESTSTAYMELSSLRSEDTAVYYCARG<br>LYYDPTRADYWGQGTLVTVSS |
| J685M2S2-25VH | 103 | EVQLVQSGAEVKKPGSSVKVSCKASGGTFSWYA<br>ISWVRQAPGQGLEWMGGITPILGTANYAQKFQG<br>RVTITADESTSTAYMELSSLRSEDTAVYYCARG<br>LYYDPTRADYWGQGTLVTVSS |
| J685M2S2-27VH | 104 | EVQLVQSGAEVKKPGSSVKVSCKASGGTFSWYA<br>ISWVRQAPGQGLEWMGGITPILGSAHYAQKFQG<br>RVTITADESTSTAYMELSSLRSEDTAVYYCARG<br>LYYDPTRADYWGQGTLVTVSS |
| J685M2S2-28VH | 105 | EVQLVQSGAEVKKPGSSVKVSCKASGGTFSWYA<br>ISWVRQAPGQGLEWMGGITPILGSAIYAQKFQG<br>RVTITADESTSTVYMELSSLRSEDTAVYYCARG<br>LYYDPTRADYWGQGTLVTVSS |
| J685M2S2-29VH | 106 | EVQLVQSGAEVKKPGSSVKVSCKASGGTFSWYA<br>ISWVRQAPGQGLEWMGGITPILGTAIYAQKFQG<br>RVTITADESTSTVYMELSSLRSEDTAVYYCARG<br>LYYDPTRADYWGQGTLVTVSS |
| J685M2S2-31VH | 107 | EVQLVQSGAEVKKPGSSVKVSCKASGGTFSIYT<br>ISWVRQAPGQGLEWMGGIIPILRNPIYAQKFQG<br>RVTITADESTSTAYMELSSLRSEDTAVYYCARG<br>LYYDPTRADYWGQGTLVTVSS |
| J685M2S2-32VH | 108 | EVQLVQSGAEVKKPGSSVKVSCKASGGTFSYYA<br>ISWVRQAPGQGLEWMGGIMPILGTPTYAQKFQG<br>RVTITADESTSTAYMELSSLRSEDTAVYYCARG<br>LYYDPTRADYWGQGTLVTVSS |
| J685M2S2-35VH | 109 | EVQLVQSGAEVKKPGSSVKVSCKASGGTFSIYT<br>ISWVRQAPGQGLEWMGGIIPILGAPIYAQKFQG<br>RVTITADESTSTAYMELSSLRSEDTAVYYCARG<br>LYYDPTRADYWGQGTLVTVSS |
| J685M2S2-37VH | 110 | EVQLVQSGAEVKKPGSSVKVSCKASGGTFSWYA<br>ISWVRQAPGQGLEWMGGITPILGSATYAQKFQG<br>RVTITADESTSTAYMELSSLRSEDTAVYYCARG<br>LYYDPTRADYWGQGTLVTVSS |
| J685M2S2-38VH | 111 | EVQLVQSGAEVKKPGSSVKVSCKASGGTFSWYS<br>ISWVRQAPGQGLEWMGGIMPILGSASYAQKFQG<br>RVTITADESTSTAYMELSSLRSEDTAVYYCARG<br>LYYDPTRADYWGQGTLVTVSS |
| J685M2S2-43VH | 112 | EVQLVQSGAEVKKPGSSVKVSCKASGGTFSWYT<br>ISWVRQAPGQGLEWMGGIMPILGTASYAQKFQG<br>RVTITADESTSTAYMELSSLRSEDTAVYYCARG<br>LYYDPTRADYWGQGTLVTVSS |
| J685M2S2-44VH | 113 | EVQLVQSGAEVKKPGSSVKVSCKASGGTFSWYS<br>ISWVRQAPGQGLEWMGGITPILGTANYAQKFQG<br>RVTITADESTSTAYMELSSLRSEDTAVYYCARG<br>LYYDPTRADYWGQGTLVTVSS |

TABLE 11-continued

List of amino acid sequences of affinity matured AE11-5 VH variants

| Clone | SEQ ID NO: | VH |
|---|---|---|
| J685M2S2-45VH | 114 | EVQLVQSGAEVKKPGSSVKVSCKASGGTFSWYA ISWVRQAPGQGLEWMGGIMPILGTATYAQKFQG RVTITADESTSTAYMELSSLRSEDTAVYYCARG LYYDPTRADYWGQGTLVTVSS |
| J685M2S2-46VH | 115 | EVQLVQSGAEVKKPGSSVKVSCKASGGTFSFYT ISWVRQAPGQGLEWMGGIMPILGSPHYAQKFQG RVTITADESTSTAYMELSSLRSEDTAVYYCARG LYYDPTRADYWGQGTLVTVSS |
| J685M2S2-47VH | 116 | EVQLVQSGAEVKKPGSSVKVSCKASGGTFSWYA ISWVRQAPGQGLEWMGGITPILGTANYAQKFQG RVTITADESTSTVYMELSSLRSEDTAVYYCARG LYYDPTRADYWGQGTLVTVSS |
| J685M2S2-48VH | 117 | EVQLVQSGAEVKKPGSSVKVSCKASGGTFSWYA ISWVRQAPGQGLEWMGGIMPILGSATYAQKFQG RVTITADESTSTAYMELSSLRSEDTAVYYCARG LYYDPTRADYWGQGTLVTVSS |
| J685M2S2-4VH | 118 | EVQLVQSGAEVKKPGSSVKVSCKASGGTFSWYA ISWVRQAPGQGLEWMGGIIPILGTPTYAQKFQG RVTITADESTSTAYMELSSLRSEDTAVYYCARG LYYDPTRADYWGQGTLVTVSS |
| J685M2S2-50VH | 119 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG VYYDPKRADYWGQGTLVTVSS |
| J685M2S2-51VH | 120 | EVQLVQSGAEVKKPGSSVKVSCKASGGTFSLYT ISWVRQAPGQGLEWMGGIMPILGAPRYAQKFQG RVTITADESTSTAYMELSSLRSEDTAVYYCARG LYYDPTRADYWGQGTLVTVSS |
| J685M2S2-52VH | 121 | EVQLVQSGAEVKKPGSSVKVSCKASGGTFSYYA ISWVRQAPGQGLEWMGGIMPILGSPIYAQKFQG RVTITADESTSTVYMELSSLRSEDTAVYYCARG LYYDPTRADYWGQGTLVTVSS |
| J685M2S2-53VH | 122 | EVQLVQSGAEVKKPGSSVKVSCKASGGTFSIYA ISWVRQAPGQGLEWMGGILPILGSPIYAQKFQG RVTITADESTSTAYMELSSLRSEDTAVYYCARG LYYDPTRADYWGQGTLVTVSS |
| J685M2S2-55VH | 123 | EVQLVQSGAEVKKPGSSVKVSCKASGGTFSIYA ISWVRQAPGQGLEWMGGIIPILGSPIYAQKFQG RVTITADESTSTAYMELSSLRSEDTAVYYCARG LYYDPTRADYWGQGTLVTVSS |
| J685M2S2-56VH | 124 | EVQLVQSGAEVKKPGSSVKVSCKASGGTFSWYA ISWVRQAPGQGLEWMGGIVPILGAPLYAQKFQG RVTITADESTSTAYMELSSLRSEDTAVYYCARG LYYDPTRADYWGQGTLVTVSS |
| J685M2S2-58VH | 125 | EVQLVQSGAEVKKPGSSVKVSCKASGGTFSIYA ISWVRQAPGQGLEWMGGIMPILGAPIYAQKFQG RVTITADESTSTAYMELSSLRSEDTAVYYCARG LYYDPTRADYWGQGTLVTVSS |
| J685M2S2-5VH | 126 | EVQLVQSGAEVKKPGSSVKVSCKASGGTFSYYT ISWVRQAPGQGLEWMGGIMPILGTPAYAQKFQG RVTITADESTSTAYMELSSLRSEDTAVYYCARG LYYDPTRADYWGQGTLVTVSS |
| J685M2S2-61VH | 127 | EVQLVQSGAEVKKPGSSVKVSCKASGGTFSWYS ISWVRQAPGQGLEWMGGITPILGAATYAQKFQG RVTITADESTSTAYMELSSLRSEDTAVYYCARG LYYDPTRADYWGQGTLVTVSS |
| J685M2S2-62VH | 128 | EVQLVQSGAEVKKPGSSVKVSCKASGGTFSWYA ISWVRQAPGQGLEWMGGIIPILGTPTYAQKFQG RVTITADESTSTVYMELSSLRSEDTAVYYCARG LYYDPTRADYWGQGTLVTVSS |

TABLE 11-continued

List of amino acid sequences of affinity matured AE11-5 VH variants

| Clone | SEQ ID NO: | VH |
|---|---|---|
| J685M2S2-63VH | 129 | EVQLVQSGAEVKKPGSSVKVSCKASGGTFSWYA ISWVRQAPGQGLEWMGGIIPILGTPIYAQKFQG RVTITADESTSTAYMELSSLRSEDTAVYYCARG LYYDPTRADYWGQGTLVTVSS |
| J685M2S2-64VH | 130 | EVQLVQSGAEVKKPGSSVKVSCKASGGTFSWYA ISWVRQAPGQGLEWMGGITPILGIGNYAQKFQG RVTITADESTSTAYMELSSLRSEDTAVYYCARG LYYDPTRADYWGQGTLVTVSS |
| J685M2S2-66VH | 131 | EVQLVQSGAEVKKPGSSVKVSCKASGGTFSIYA ISWVRQAPGQGLEWMGGIVPILGAATYAQKFQG RVTITADESTSTAYMELSSLRSEDTAVYYCARG LYYDPTRADYWGQGTLVTVSS |
| J685M2S2-67VH | 132 | EVQLVQSGAEVKKPGSSVKVSCKASGGTFSWYA ISWVRQAPGQGLEWMGGITPILGSSTYAQKFQG RVTITADESTSTAYMELSSLRSEDTAVYYCARG LYYDPTRADYWGQGTLVTVSS |
| J685M2S2-68VH | 133 | EVQLVQSGAEVKKPGSSVKVSCKASGGTFSWYT ISWVRQAPGQGLEWMGGIMPILGTANYAQKFQG RVTITADESTSTAYMELSSLRSEDTAVYYCARG LYYDPTRADYWGQGTLVTVSS |
| J685M2S2-6VH | 134 | EVQLVQSGAEVKKPGSSVKVSCKASGGTFSWYA ISWVRQAPGQGLEWMGGITPILGNSIYAQKFQG RVTITADESTSTAYMELSSLRSEDTAVYYCARG LYYDPTRADYWGQGTLVTVSS |
| J685M2S2-70VH | 135 | EVQLVQSGAEVKKPGSSVKVSCKASGGTFSWYA ISWVRQAPGQGLEWMGGITPILGSPIYAQKFQG RVTITADESTSTAYMELSSLRSEDTAVYYCARG LYYDPTRADYWGQGTLVTVSS |
| J685M2S2-71VH | 136 | EVQLVQSGAEVKKPGSSVKVSCKASGGTFSWYA ISWVRQAPGQGLEWMGGIMPILGTPTYAQKFQG RVTITADESTSTAYMELSSLRSEDTAVYYCARG LYYDPTRADYWGQGTLVTVSS |
| J685M2S2-72VH | 137 | EVQLVQSGAEVKKPGSSVKVSCKASGGTFSYYA ISWVRQAPGQGLEWMGGITPILGAANYAQKFQG RVTITADESTSTVYMELSSLRSEDTAVYYCARG LYYDPTRADYWGQGTLVTVSS |
| J685M2S2-73VH | 138 | EVQLVQSGAEVKKPGSSVKVSCKASGGTFSWYA ISWVRQAPGQGLEWMGGITPILGAAIYAQKFQG RVTITADESTSTAYMELSSLRSEDTAVYYCARG LYYDPTRADYWGQGTLVTVSS |
| J685M2S2-75VH | 139 | EVQLVQSGAEVKKPGSSVKVSCKASGGTFSWYA ISWVRQAPGQGLEWMGGITPILGTATYAQKFQG RVTITADESTSTAYMELSSLRSEDTAVYYCARG LYYDPTRADYWGQGTLVTVSS |
| J685M2S2-76VH | 140 | EVQLVQSGAEVKKPGSSVKVSCKASGGTFSWYS ISWVRQAPGQGLEWMGGITPILGSAHYAQKFQG RVTITADESTSTAYMELSSLRSEDTAVYYCARG LYYDPTRADYWGQGTLVTVSS |
| J685M2S2-77VH | 141 | EVQLVQSGAEVKKPGSSVKVSCKASGGTFSWYA ISWVRQAPGQGLEWMGGITPILGNAIYAQKFQG RVTITADESTSTAYMELSSLRSEDTAVYYCARG LYYDPTRADYWGQGTLVTVSS |
| J685M2S2-78VH | 142 | EVQLVQSGAEVKKPGSSVKVSCKASGGTFSWYA ISWVRQAPGQGLEWMGGITPILRSAVYAQKFQG RVTITADESTSTVYMELSSLRSEDTAVYYCARG LYYDPTRADYWGQGTLVTVSS |
| J685M2S2-7VH | 143 | EVQLVQSGAEVKKPGSSVKVSCKASGGTFSWYS ISWVRQAPGQGLEWMGGIMPILGTANYAQKFQG RVTITADESTSTAYMELSSLRSEDTAVYYCARG LYYDPTRADYWGQGTLVTVSS |

TABLE 11-continued

List of amino acid sequences of affinity matured AE11-5 VH variants

| Clone | SEQ ID NO: | VH |
|---|---|---|
| J685M2S2-80VH | 144 | EVQLVQSGAEVKKPGSSVKVSCKASGGTFSWYAISWVRQAPGQGLEWMGGITPILGTASYAQKFQGRVTITADESTSTAYMELSSLRSEDTAVYYCARGLYYDPTRADYWGQGTLVTVSS |
| J685M2S2-81VH | 145 | EVQLVQSGAEVKKPGSSVKVSCKASGGTFSWYAISWVRQAPGQGLEWMGGITPILGTAIYAQKFQGRVTITADESTSTAYMELSSLRSEDTAVYYCARGLYYDPTRADYWGQGTLVTVSS |
| J685M2S2-82VH | 146 | EVQLVQSGAEVKKPGSSVKVSCKASGGTFSWYAISWVRQAPGQGLEWMGGITPILGSPAYAQKFQGRVTITADESTSTAYMELSSLRSEDTAVYYCARGLYYDPTRADYWGQGTLVTVSS |
| J685M2S2-83VH | 147 | EVQLVQSGAEVKKPGSSVKVSCKASGGTFSRYAISWVRQAPGQGLEWMGGIIPILGPASYAQKFQGRVTITADESTSTAYMELSSLRSEDTAVYYCARGLYYDPTRADYWGQGTLVTVSS |
| J685M2S2-84VH | 148 | EVQLVQSGAEVKKPGSSVKVSCKASGGTFSWYAISWVRQAPGQGLEWMGGITPILDAAIYAQKFQGRVTITADESTSTAYMELSSLRSEDTAVYYCARGLYYDPTRADYWGQGTLVTVSS |
| J685M2S2-86VH | 149 | EVQLVQSGAEVKKPGSSVKVSCKASGGTFSWYTISWVRQAPGQGLEWMGGIMPILGIPNYAQKFQGRVTITADESTSTAYMELSSLRSEDTAVYYCARGLYYDPTRADYWGQGTLVTVSS |
| J685M2S2-87VH | 150 | EVQLVQSGAEVKKPGSSVKVSCKASGGTFSIYAISWVRQAPGQGLEWMGGITPILGSAIYAQKFQGRVTITADESTSTAYMELSSLRSEDTAVYYCARGLYYDPTRADYWGQGTLVTVSS |
| J685M2S2-88VH | 151 | EVQLVQSGAEVKKPGSSVKVSCKASGGTFSYYAISWVRQAPGQGLEWMGGIMPILGTATYAQKFQGRVTITADESTSTVYMELSSLRSEDTAVYYCARGLYYDPTRADYWGQGTLVTVSS |
| J685M2S2-89VH | 152 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDPKRADYWGQGTLVTVSS |
| J685M2S2-8VH | 153 | EVQLVQSGAEVKKPGSSVKVSCKASGGTFNWYTISWVRQAPGQGLEWMGGIMPILGTANYAQKFQGRVTITADESTSTAYMELSSLRSEDTAVYYCARGLYYDPTRADYWGQGTLVTVSS |
| J685M2S2-90VH | 154 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDFTRADYWGQGTLVTVSS |
| J685M2S2-91VH | 155 | EVQLVQSGAEVKKPGSSVKVSCKASGGTFSWYAISWVRQAPGQGLEWMGGIIPILRFPTYAQKFQGRVTITADESTSTVYMELSSLRSEDTAVYYCARGLYYDPTRADYWGQGTLVTVSS |
| J685M2S2-92VH | 156 | EVQLVQSGAEVKKPGSSVKVSCKVSGGTFSWYSISWVRQAPGQGLEWMGGILPILDTANYAQKFQGRVTITADESTSTAYMELSSLRSEDTAVYYCARGLYYDPTRADYWGQGTLVTVSS |
| J685M2S2-93VH | 157 | EVQLVQSGAEVKKPGSSVKVSCKASGGTFSWYAISWVRQAPGQGLEWMGGIMPILGTAVYAQKFQGRVTITADESTSTAYMELSSLRSEDTAVYYCARGLYYDPTRADYWGQGTLVTVSS |
| J685M2S2-94VH | 158 | EVQLVQSGAEVKKPGSSVKVSCKASGGTFSIYSISWVRQAPGQGLEWMGGILPILGTANYAQKFQGRVTITADESTSTVYMELSSLRSEDTAVYYCARGLYYDPTRADYWGQGTLVTVSS |

TABLE 11-continued

List of amino acid sequences of affinity matured AE11-5 VH variants

| Clone | SEQ ID NO: | VH |
|---|---|---|
| J688M2-11VH | 159 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG VYYDPTRADYWGQGTLVTVSS |
| J688M2-13VH | 160 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYYDPSRADYWGQGTLVTVSS |
| J688M2-14VH | 161 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG VYFNPTRADYWGQGTLVTVSS |
| J688M2-16VH | 162 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYYDPARFDYWGQGTLVTVSS |
| J688M2-20VH | 163 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYYNPSRADYWGQGTLVTVSS |
| J688M2-21VH | 164 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYYDPKRADYWGQGTLVTVSS |
| J688M2-22VH | 165 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYYDPRRADYWGQGTLVTVSS |
| J688M2-28VH | 166 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG FYYDPTRADYWGQGTLVTVSS |
| J688M2-29VH | 167 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYYDFTRADYWGQGTLVTVSS |
| J688M2-2VH | 168 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYFDPKRADYWGQGTLVTVSS |
| J688M2-37VH | 169 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG VYFDPTRADYWGQGTLVTVSS |
| J688M2-3VH | 170 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG IYYDPSRADYWGQGTLVTVSS |
| J688M2-46VH | 171 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARS LYYERTRADYWGQGTLVTVSS |
| J688M2-48VH | 172 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARW RFYIPIRFDYWGQGTLVTVSS |
| J688M2-4VH | 173 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG VYYDFTRADYWGQGTLVTVSS |

TABLE 11-continued

List of amino acid sequences of affinity matured AE11-5 VH variants

| Clone | SEQ ID NO: | VH |
|---|---|---|
| J688M2-50VH | 174 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLFYDPSRADYWGQGTLVTVSS |
| J688M2-52VH | 175 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPVRADYWGQGTLVTVSS |
| J688M2-56VH | 176 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPIRADYWGQGTLVTVSS |
| J688M2-57VH | 177 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGIYYDPKRADYWGQGTLVTVSS |
| J688M2-58VH | 178 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYNPIRFDYWGQGTLVTVSS |
| J688M2-64VH | 179 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDPARADYWGQGTLVTVSS |
| J688M2-65VH | 180 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVFFDPTRADYWGQGTLVTVSS |
| J688M2-68VH | 181 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVFYNPTRADYWGQGTLVTVSS |
| J688M2-69VH | 182 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYEGPSADYWGQGTLVTVSS |
| J688M2-6VH | 183 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYAPNRADYWGQGTLVTVSS |
| J688M2-73VH | 184 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLFYDPTRADYWGQGTLVTVSS |
| J688M2-74VH | 185 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYNPTRADYWGQGTLVTVSS |
| J688M2-75VH | 186 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPARADYWGQGTLVTVSS |
| J688M2-7VH | 187 | EVQLVQSGAEVKKSGSSVKVSCKASGGTFSSYAISWVRQAPGQGLEWMGGIIPILGTANYAQKFQGRVTITADESTSTVYMELSSLRSEDTAVYYCARGVYYDPGRADYWGQGTLVTVSS |
| J688M2-81VH | 188 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDPSRADYWGQGTLVTVSS |

TABLE 11-continued

List of amino acid sequences of affinity matured AE11-5 VH variants

| Clone | SEQ ID NO: | VH |
|---|---|---|
| J688M2-82VH | 189 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYFDPSRFDYWGQGTLVTVSS |
| J688M2-83VH | 190 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYFDFTRADYWGQGTLVTVSS |
| J688M2-84VH | 191 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGIYYDPTRADYWGQGTLVTVSS |
| J688M2-88VH | 192 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYFDPSRADYWGQGTLVTVSS |
| J688M2-89VH | 193 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPSRFDYWGQGTLVTVSS |
| J688M2-8VH | 194 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGQYYDTSRADYWGQGTLVTVSS |
| J688M2-90VH | 195 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARSLYYDTTRFDYWGQGTLVTVSS |
| J688M2-92VH | 196 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVFYDPTRADYWGQGTLVTVSS |
| J688M2-94VH | 197 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGIYYDPARADYWGQGTLVTVSS |
| J688M2-95VH | 198 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLFYDPRRADYWGQGTLVTVSS |
| J688M2-96VH | 199 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDTTRADYWGQGTLVTVSS |
| J693FRM2S2L-32VH | 200 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDPARADYWGQGTLVTVSS |
| J693FRM2S2L-40VH | 201 | EVQLVQSGAEVKKPGSSVKVSCKASGGTFSSYAISWVRQAPGQGLEWMGGIIPILGTANYAQKFQGRVTITADESTSTVYMELSSLRSEDTAVYYCSRGLYYDPTRADYWGQGTLVTVSS |
| J693FRM2S2L-70VH | 202 | EVQLVQSGAEVMKPGSSVKVSCKASGGTFSSYAISWVRQAPGQGLEWMGGIIPILGTANYAQKFQGRVTITADESTSTVYMELSSLRSEDTAVYYCTRGLYYDPTRADYWGQGTLVTVSS |
| J693FRM2S2R-29VH | 203 | EVQLVQSGAEVKKPGASVKVSCKASGYTFNNYAISWVRQAPGQGLEWMGGIIPILGTANYAQKFQGRVTITADESTSTVYMELSSLRSEDTAVYYCARGLYYDPTRADYWGQGTLVTVSS |

TABLE 11-continued

List of amino acid sequences of affinity matured AE11-5 VH variants

| Clone | SEQ ID NO: | VH |
|---|---|---|
| J693FRM2S2R-46VH | 204 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCTRG LYYDPTRADYWGQGTLVTVSS |
| J693FRM2S2R-65VH | 205 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCTRG IYYDPTRADYWGQGTLVTVSS |
| J693M2S2L-17VH | 206 | EVQLVQSGAEVKKPGSSVKVSCKASGGTFSSYA ISWVRQAPGQGLEWMGGIIPILGTANYAQEFQG RVTITADESTSTVYMELSSLRSEDTAVYYCARG LYYDPTRADYWGQGTLVTVSS |
| J693M2S2L-32VH | 207 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCVRG LYYDPTRADYWGQGTLVTVSS |
| J693M2S2L-67VH | 208 | EVQLVQSGAEVKKPGSSVKVSCKASGGTFSSYA ISWVRQAPGQGLEWMGGIIPILGTASYAQKFQG RVTITADESTSTVYMELSSLRSEDTAVYYCARG LYYDPTRADYWGQGTLVTVSS |
| J693M2S2L-75VH | 209 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCAKG LYYDPTRADYWGQGTLVTVSS |
| J693M2S2L-78VH | 210 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCERG LYYDPTRADYWGQGTLVTVSS |
| J693M2S2L-79VH | 211 | EVQLVQSGAEVKKPGSSVKVSCKASGGTFSNYA ISWVRQAPGQGLEWMGGIIPILGTANYAQKFQG RVTITADESTSTVYMELSSLRSEDTAVYYCARG LYYDPTRADYWGQGTLVTVSS |
| J693M2S2L-94VH | 212 | EVQLVQSGAEVKKPGSSVKVSCKASGGTFSSYA ISWVRQAPGQGLEWMGGIIPILGTANYAHKFQG RVTITADESTSTVYMELSSLRSEDTAVYYCARG LYYDPTRADYWGQGTLVTVSS |
| J693M2S2R-22VH | 213 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYYDPTRADCWGQGTLVTVSS |
| J693M2S2R-24VH | 214 | EVQLVQSGAEVKKPGSSVKVSCKASGGTFSSYA ISWVQQAPGQGLEWMGGIIPILGTANYAQKFQG RVTITADESTSTVYMELSSLRSEDTAVYYCARG LYYDPTRADYWGQGTLVTVSS |
| J693M2S2R-2VH | 215 | EVQLVQSGAEVKKPGSSVKVSCKASGGTFSSYA ISWVRQAPGQGLEWMGGITPILGTANYAQKFQG RVTITADESTSTVYMELSSLRSEDTAVYYCARG LYYDPTRADYWGQGTLVTVSS |
| J693M2S2R-31VH | 216 | EVQLVQSGAEVKKPGSSVKVSCKASGGTFSSYA ISWVRQAPGQGLEWMGGIIPILGTANYAQKFQG RVTITADESTSTVYMELSSLRSEDTAVYYCARG LYYDPTRADYWGQGTLVTVSS |
| J693M2S2R-71VH | 217 | EVQLVQSGAEVKKPGSSVKVSCKASGGTFSSYA TSWVRQAPGQGLEWMGGIIPILGTANYAQKFQG RVTITADESTSTVYMELSSLRSEDTAVYYCARG LYYDPTRADYWGQGTLVTVSS |
| J693M2S2R-84VH | 218 | EVQLVQSGAEVKKPGSSVKVSCKASGGTFSSYA ISWVRQAPGQGLEWMGGIIPILGTANYAQKFLG RVTITADESTSTVYMELSSLRSEDTAVYYCARG LYYDPTRADYWGQGTLVTVSS |

TABLE 11-continued

List of amino acid sequences of affinity matured AE11-5 VH variants

| Clone | SEQ ID NO: | VH |
|---|---|---|
| J693M2S2R-89VH | 219 | EVQLVQSGAEVKKPGSSVKVSCKASGGTSSSYA ISWVRQAPGQGLEWMGGIIPILGTANYAQKFQGRVTITADESTSTVYMELSSLRSEDTAVYYCARGLYYDPTRADYWGQGTLVTVSS |
| J703M1S3-10VH | 220 | EVQLVQSGAEVKKPGSSVKVSCKASGGTFSWYA ISWVRQAPGQGLEWMGGITPILGSATYAQKFQGRVTITADESTSTVYMELSSLRSEDTAVYYCARGLYYDPKRADYWGQGTLVTVSS |
| J703M1S3-11VH | 221 | EVQLVQSGAEVKKPGSSVKVSCKASGGTFSWYA ISWVRQAPGQGLEWMGGITPILGAASYAQKFQGRVTITADESTSTVYMELSSLRSEDTAVYYCARGIYYDPTRADYWGQGTLVTVSS |
| J703M1S3-12VH | 222 | EVQLVQSGAEVKKPGSSVKVSCKASGGTFSWYA ISWVRQAPGQGLEWMGGITPILGAASYAQKFQGRVTITADESTSTVYMELSSLRSEDTAVYYCARGIYYDPARADYWGQGTLVTVSS |
| J703M1S3-13VH | 223 | EVQLVQSGAEVKKPGSSVKVSCKASGGTFSWYA ISWVRQAPGQGLEWMGGITPILGAANYAQKFQGRVTITADESTSTVYMELSSLRSEDTAVYYCARGVYYDPKRADYWGQGTLVTVSS |
| J703M1S3-14VH | 224 | EVQLVQSGAEVKKPGSSVKVSCKASGGTFSWYT ISWVRQAPGQGLEWMGGIMPILGSPTYAQKFQGRVTITADESTSTVYMELSSLRSEDTAVYYCARGVYYDPRRADYWGQGTLVTVSS |
| J703M1S3-16VH | 225 | EVQLVQSGAEVKKPGSSVKVSCKASGGTFSWYA ISWVRQAPGQGLEWMGGITPILGSATYAQKFQGRVTITADESTSTVYMELSSLRSEDTAVYYCARGIYYDPKRADYWGQGTLVTVSS |
| J703M1S3-17VH | 226 | EVQLVQSGAEVKKPGSSVKVSCKASGGTFSWYA ISWVRQAPGQGLEWMGGIVPILGTPIYAQKFQGRVTITADESTSTVYMELSSLRSEDTAVYYCARGVYYDPKRADYWGQGTLVTVSS |
| J703M1S3-18VH | 227 | EVQLVQSGAEVKKPGSSVKVSCKASGGTFSWYA ISWVRQAPGQGLEWMGGITPILGSANYAQKFQGRVTITADESTSTVYMELSSLRSEDTAVYYCARGLYYDPARADYWGQGTLVTVSS |
| J703M1S3-19VH | 228 | EVQLVQSGAEVKKPGSSVKVSCKASGGTFSWYA ISWVRQAPGQGLEWMGGITPILGSPTYAQKFQGRVTITADESTSTVYMELSSLRSEDTAVYYCARGVYYDPKRADYWGQGTLVTVSS |
| J703M1S3-1VH | 229 | EVQLVQSGAEVKKPGSSVKVSCKASGGTFSWYT ISWVRQAPGQGLEWMGGIMPILGTPVYAQKFQGRVTITADESTSTVYMELSSLRSEDTAVYYCARGVYYDFRRANYWGQGTLVTVSS |
| J703M1S3-20VH | 230 | EVQLVQSGAEVKKPGSSVKVSCKASGGTFSWYA ISWVRQAPGQGLEWMGGITPILGAATYAQKFQGRVTITADESTSTVYMELSSLRSEDTAVYYCARGIYYDPKRADYWGQGTLVTVSS |
| J703M1S3-21VH | 231 | EVQLVQSGAEVKKPGSSVKVSCKASGGTFSWYA ISWVRQAPGQGLEWMGGITPILGDPIYAQKFQGRVTITADESTSTVYMELSSLRSEDTAVYYCARGIYYDPKRADYWGQGTLVTVSS |
| J703M1S3-22VH | 232 | EVQLVQSGAEVKKPGSSVKVSCKASGGTFSWYA ISWVRQAPGQGLEWMGGITPILGNPIYAQKFQGRVTITADESTSTVYMELSSLRSEDTAVYYCARGIYYDYKRADYWGQGTLVTVSS |
| J703M1S3-25VH | 233 | EVQLVQSGAEVKKPGSSVKVSCKASGGTFSWYA ISWVRQAPGQGLEWMGGITPILGSANYAQKFQGRVTITADESTSTVYMELSSLRSEDTAVYYCARGLFYDFRRADYWGQGTLVTVSS |

TABLE 11-continued

List of amino acid sequences of affinity matured AE11-5 VH variants

| Clone | SEQ ID NO: | VH |
|---|---|---|
| J703M1S3-28VH | 234 | EVQLVQSGAEVKKPGSSVKVSCKASGGTFAWYAISWVRQAPGQGLEWMGGITPILGNAIYAQKFQGRVTITADESTSTVYMELSSLRSEDTAVYYCARGVYYDPKRADYWGQGTLVTVSS |
| J703M1S3-29VH | 235 | EVQLVQSGAEVKKPGSSVKVSCKASGGTFSWYAISWVRQAPGQGLEWMGGITPILGNPIYAQKFQGRVTITADESTSTVYMELSSLRSEDTAVYYCARGVYYDPKRADYWGQGTLVTVSS |
| J703M1S3-2VH | 236 | EVQLVQSGAEVKKPGSSVKVSCKASGGTFSWYATSWVRQAPGQGLEWMGGITPILGSPIYAQKFQGRVTITADESTSTVYMELSSLRSEDTAVYYCARGVYYDHRRADYWGQGTLVTVSS |
| J703M1S3-34VH | 237 | EVQLVQSGAEVKKPGSSVKVSCKASGGTFSWYAISWVRQAPGQGLEWMGGITPILGSPIYAQKFQGRVTITADESTSTVYMELSSLRSEDTAVYYCARGVYYDYKRADYWGQGTLVTVSS |
| J703M1S3-37VH | 238 | EVQLVQSGAEVKKPGSSVKVSCKASGGTFSWYAISWVRQAPGQGLEWMGGITPILGSAIYAQKFQGRVTITADESTSTVYMELSSLRSEDTAVYYCARGVYYDPKRADYWGQGTLVTVSS |
| J703M1S3-38VH | 239 | EVQLVQSGAEVKKPGSSVKVSCKASGGTFSWYAISWVRQAPGQGLEWMGGITPILGTPIYAQKFQGRVTITADESTSTVYMELSSLRSEDTAVYYCARGVYYDFKRADYWGQGTLVTVSS |
| J703M1S3-3VH | 240 | EVQLVQSGAEVKKPGSSVKVSCKASGGTFSWYTISWVRQAPGQGLEWMGGIMPILGTPIYAQKFQGRVTITADESTSTVYMELSSLRSEDTAVYYCARGVYYDPRRADYWGQGTLVTVSS |
| J703M1S3-41VH | 241 | EVQLVQSGAEVKKPGSSVKVSCKASGGTFSWYAISWVRQAPGQGLEWMGGITPILGSANYAQKFQGRVTITADESTSTVYMELSSLRSEDTAVYYCARGVYYDPKRADYWGQGTLVTVSS |
| J703M1S3-42VH | 242 | EVQLVQSGAEVKKPGSSVKVSCKASGGTFSWYAISWVRQAPGQGLEWMGGITPILGAPVYAQKFQGRVTITADESTSTVYMELSSLRSEDTAVYYCARGVYYDPKRADYWGQGTLVTVSS |
| J703M1S3-45VH | 243 | EVQLVQSGAEVKKPGSSVKVSCKASGGTFSWYAISWVRQAPGQGLEWMGGITPILGSAIYAQKFQGRVTITADESTSTVYMELSSLRSEDTAVYYCARGVYYDPKRADYWGQGTLVTVSS |
| J703M1S3-46VH | 244 | EVQLVQSGAEVKKPGSSVKVSCKASGGTFSWYAISWVRQAPGQGLEWMGGITPILGSPIYAQKFQGRVTITADESTSTVYMELSSLRSEDTAVYYCARGIYYDPKRADYWGQGTLVTVSS |
| J703M1S3-47VH | 245 | EVQLVQSGAEVKKPGSSVKVSCKASGGTFSWYTISWVRQAPGQGLEWMGGIMPILGSANYAQKFQGRVTITADESTSTVYMELSSLRSEDTAVYYCARGIYYDPKRADYWGQGTLVTVSS |
| J703M1S3-4VH | 246 | EVQLVQSGAEVKKPGSSVKVSCKASGGTFSWYAISWVRQAPGQGLEWMGGITPILGNAIYAQKFQGRVTITADESTSTVYMELSSLRSEDTAVYYCARGIYYDPKRADYWGQGTLVTVSS |
| J703M1S3-50VH | 247 | EVQLVQSGAEVKKPGSSVKVSCKASGGTFSWYAISWVRQAPGQGLEWMGGITPILGAATYAQKFQGRVTITADESTSTVYMELSSLRSEDTAVYYCARGVYYDPKRADYWGQGTLVTVSS |
| J703M1S3-51VH | 248 | EVQLVQSGAEVKKPGSSVKVSCKASGGTFSWYAISWVRQAPGQGLEWMGGITPILGSPIYAQKFQGRVTITADESTSTVYMELSSLRSEDTAVYYCARGIYYDYRRADYWGQGTLVTVSS |

TABLE 11-continued

List of amino acid sequences of affinity matured AE11-5 VH variants

| Clone | SEQ ID NO: | VH |
|---|---|---|
| J703M1S3-53VH | 249 | EVQLVQSGAEVKKPGSSVKVSCKASGGTFSWYAISWVRQAPGQGLEWMGGIMPILGIPTYAQKFQGRVTITADESTSTVYMELSSLRSEDTAVYYCARGVYYDPARADYWGQGTLVTVSS |
| J703M1S3-54VH | 250 | EVQLVQSGAEVKKPGSSVKVSCKASGGTFSWYAISWVRQAPGQGLEWMGGITPILGSPIYAQKFQGRVTITADESTSTVYMELSSLRSEDTAVYYCARGVYYDPKRADYWGQGTLVTVSS |
| J703M1S3-57VH | 251 | EVQLVQSGAEVKKPGSSVKVSCKASGGTFSWYAISWVRQAPGQGLEWMGGITPILGSAVYAQKFQGRVTITADESTSTVYMELSSLRSEDTAVYYCARGVYYDPKRADYWGQGTLVTVSS |
| J703M1S3-5VH | 252 | EVQLVQSGAEVKKPGSSVKVSCKASGGTFSWYAISWVRQAPGQGLEWMGGITPILGSAIYAQKFQGRVTITADESTSTVYMELSSLRSEDTAVYYCARGIYYDYKRADYWGQGTLVTVSS |
| J703M1S3-62VH | 253 | EVQLVQSGAEVKKPGSSVKVSCKASGGTFSWYAISWVRQAPGQGLEWMGGITPILGYPIYAQKFQGRVTITADESTSTVYMELSSLRSEDTAVYYCARGVYYDPKRADYWGQGTLVTVSS |
| J703M1S3-6VH | 254 | EVQLVQSGAEVKKPGSSVKVSCKASGGTFSWYAISWVRQAPGQGLEWMGGITPILGAATYAQKFQGRVTITADESTSTVYMELSSLRSEDTAVYYCARGIYYDFRRADYWGQGTLVTVSS |
| J703M1S3-72VH | 255 | EVQLVQSGAEVKKPGSSVKVSCKASGGTFSWYPISWVRQAPGQGLEWMGGITPILGSAIYAQKFQGRVTITADESTSTVYMELSSLRSEDTAVYYCARGVYYDFRRADYWGQGTLVTVSS |
| J703M1S3-78VH | 256 | EVQLVQSGAEVKKPGSSVKVSCKASGGTFSWYAISWVRQAPGQGLEWMGGITPILGTANYAQKFQGRVTITADESTSTVYMELSSLRSEDTAVYYCARGVYYDPKRADYWGQGTLVTVSS |
| J703M1S3-79VH | 257 | EVQLVQSGAEVKKPGSSVKVSCKASGGTFSWYAISWVRQAPGQGLEWMGGITPILGSAVYAQKFQGRVTITADESTSTVYMELSSLRSEDTAVYYCARGIYYDPKRADYWGQGTLVTVSS |
| J703M1S3-7VH | 258 | EVQLVQSGAEVKKPGSSVKVSCKASGGTFSWYAISWVRQAPGQGLEWMGGITPILGNPIYAQKFQGRVTITADESTSTVYMELSSLRSEDTAVYYCARGVYYDPARADYWGQGTLVTVSS |
| J703M1S3-81VH | 259 | EVQLVQSGAEVKKPGSSVKVSCKASGGTFSWYTISWVRQAPGQGLEWMGGIMPILGAPNYAQKFQGRVTITADESTSTVYMELSSLRSEDTAVYYCARGVYYDYTRADYWGQGTLVTVSS |
| J703M1S3-83VH | 260 | EVQLVQSGAEVKKPGSSVKVSCKASGGTFAWYAISWVRQAPGQGLEWMGGITPILGSPTYAQKFQGRVTITADESTSTVYMELSSLRSEDTAVYYCARGVYYDPKRADYWGQGTLVTVSS |
| J703M1S3-86VH | 261 | EVQLVQSGAEVKKPGSSVKVSCKASGGTFGWYATSWVRQAPGQGLEWMGGIIPILGTPNYAQKFQGRVTITADESTSTVYMELSSLRSEDTAVYYCARGVYYDPKRADYWGQGTLVTVSS |
| J703M1S3-87VH | 262 | EVQLVQSGAEVKKPGSSVKVSCKASGGTFSWYTISWVRQAPGQGLEWMGGIMPILGTPTYAQKFQGRVTITADESTSTVYMELSSLRSEDTAVYYCARGVYYDPKRADYWGQGTLVTVSS |
| J703M1S3-88VH | 263 | EVQLVQSGAEVKKPGSSVKVSCKASGGTFSWYTISWVRQAPGQGLEWMGGIMPILGSPNYAQKFQGRVTITADESTSTVYMELSSLRSEDTAVYYCARGIYYDPKRADYWGQGTLVTVSS |

TABLE 11-continued

List of amino acid sequences of affinity matured AE11-5 VH variants

| Clone | SEQ ID NO: | VH |
|---|---|---|
| J703M1S3-91VH | 264 | EVQLVQSGAEVKKPGSSVKVSCKASGGTFSWYA ISWVRQAPGQGLEWMGGIMPILGSATYAQKFQG RVTITADESTSTVYMELSSLRSEDTAVYYCARG VYFDPKRADYWGQGTLVTVSS |
| J703M1S3-93VH | 265 | EVQLVQSGAEVKKPGSSVKVSCKASGGTFSWYA ISWVRQAPGQGLEWMGGITPILGAANYAQKFQG RVTITADESTSTVYMELSSLRSEDTAVYYCARG LYYDPKRADYWGQGTLVTVSS |
| J703M1S3-9VH | 266 | EVQLVQSGAEVKKPGSSVKVSCKASGGTFSWYP ISWVRQAPGQGLEWMGGITPILGAGIYAQKFQG RVTITADESTSTVYMELSSLRSEDTAVYYCARG VYYDFKRADYWGQGTLVTVSS |

Table 12 provides a list of amino acid sequences of VL regions of affinity matured fully human TNF antibodies derived from AE11-5. Amino acid residues of individual CDRs of each VH sequence are indicated in bold.

TABLE 12

List of amino acid sequences of affinity matured AE11-5 VL variants

| Clone | SEQ ID NO: | VL |
|---|---|---|
| J685M2S2-17Vk | 267 | EIVLTQSPDFQSVTPKEKVTITCRASQSIGSSLH WYQQKPDQSPKLLIKHASQSISGVPSRFSGSGSG TDFTLTINSLEAEDAATYYCHQSSSSPPPTFGQG TKVEIK |
| J685M2S2-94Vk | 268 | EIVLTQSPDFQSVTPKEKVTITCRASQSIGSSLH WYQQKPDQSPKLLIKHASQSISGVPSRFSGSGSG TDFTLTINSLEAEDAATYYCHQSSSSPPPTFGQW TKVEIK |
| J688M2-37Vk | 269 | EIVLTQSPDFQSVTPKEKVTITCRARQSIGSSLH WYQQKPDQSPKLLIKHASQSISGVPSRFSGSGSG TNFTLTINSLEAEDAATYYCHQSSSSPPPTFGQG TKVEIK |
| J688M2-90Vk | 270 | EIVLTQSPDFQSVTPKEKVTITCRASQSIGSSLH WYQQKPDQSPKLLIKHASQSISGVPSRFSGSGSG TDFTLTINSLEAEDAATYYCHQSSSSPPPTFGQG TKVEIK |
| J693FRM2S2L-26Vk | 271 | EIVLTQSPDFQSVTPKEKVTITCRASQSIGRSLH WYQQKPDQSPKLLIKHASQSVSGVPSRFSGSGSG TDFTLTINSLEAEDAATYYCHQNRSSPPSTFGQG TKVEIK |
| J693FRM2S2L-27Vk | 272 | EIVLTQSPDFQSVTPKEKVTITCRASQSIGRSLH WYQQKPDQSPKLLIKYASQSLSGVPSRFSGSGSG TDFTLTINSLEAEDAATYYCHQSSSSPPVTFGQG TKVEIK |
| J693FRM2S2L-29Vk | 273 | EIVLTQSPDFQSVTPKEKVTITCRASQSIGSSLH WYQQKPDQSPKLLIKYASQSISGVPSRFSGSGSG TDFTLTINSLEAEDAATYYCHQRSNLPAPTFGQG TKVEIK |
| J693FRM2S2L-39Vk | 274 | EIVLTQSPDFQSVTPKEKVTITCRASQIIGGSLH WYQQKPDQSPKLLIKYASQSFSGVPSRFSGSGSG TDFTLTINSLEAEDAATYYCHQPICSPPRTFGQG TKVEIK |
| J693FRM2S2L-3Vk | 275 | EIVLTQSPDFQSVTPKEKVTITCRASQTIGSNLH WYQQKPDQSPKLLIKYASQSLSGVPSRFSGSGSG TDFTLTINSLEAEDAATYYCHQCSISPPATFGQG TKVEIK |

TABLE 12-continued

List of amino acid sequences of affinity matured AE11-5 VL variants

| Clone | SEQ ID NO: | VL |
|---|---|---|
| J693FRM2S2L-40Vk | 276 | EIVLTQSPDFQSVTPKEKVTITCRASQCIGTSLHWYQQKPDQSPKLLIKYDSQSISGVPSRFSGSGSGTDFTLTINSLEAEDAATYYCHQNSSSPPPTFGQGTKVEIK |
| J693FRM2S2L-42Vk | 277 | EIVLTQSPDFQSVTPKEKVTITCRASQNIGNSLHWYQQKPDQSPKLLIKYTSQSISGVPSRFSGSGSGTDFTLTINSLEAEDAATYYCHQTSSLPLPTFGQGTKVEIK |
| J693FRM2S2L-43Vk | 278 | EIVLTQSPDFQSVTPKEKVTITCRASQSIGSSLHWYQQKPDQSPKLLIKYVSQSISGVPSRFSGSGSGTDFTLTINSLEAEDAATYYCHQISDLPTSTFGQGTKVEIK |
| J693FRM2S2L-45Vk | 279 | EIVLTQSPDFQSVTPKEKVTITCRASQRIGSNLHWYQQKPDQSPKLLIKYASQSISGVPSRFSGSGSGTDFTLTINSLEAEDAATYYCHQGSSLPPPTFGQGTKVEIK |
| J693FRM2S2L-46Vk | 280 | EIVLTQSPDFQSVTPKEKVTITCRASQCIGSSLHWYQQKPDQSPKLLIKHTSQSNSGVPSRFSGSGSGTDFTLTINSLEAEDAATYYCHQSNSSPLSTFGQGTKVEIK |
| J693FRM2S2L-47Vk | 281 | EIVLTQSPDFQSVTPKEKVTITCRASQNIGGSLHWYQQKPDQSPKLLIKYASQSISGVPSRFSGSGSGTDFTLTINSLEAEDAATYYCHQNSSLPLPTFGQGTKVEIK |
| J693FRM2S2L-48Vk | 282 | EIVLTQSPDFQSVTPKEKVTITCRASQSIGSRLHWYQQKPDQSPKLLIKYASQSISGVPSRFSGSGSGTDFTLTINSLEAEDAATYYCHQSSKSPPPTFGQGTKVEIK |
| J693FRM2S2L-52Vk | 283 | EIVLTQSPDFQSVTPKEKVTITCRASQSIGSCLHWYQQKPDQSPKLLIKYASQSVSGVPSRFSGSGSGTDFTLTINSLEAEDAATYYCHQRSSLPTPTFGQGTKVEIK |
| J693FRM2S2L-53Vk | 284 | EIVLTQSPDFQSVTPKEKVTITCRASQSIGGRLHWYQQKPDQSPKLLIKYASQSLSGVPSRFSGSGSGTDFTLTINSLEAEDAATYYCHQASSSPSTTFGQGTKVEIK |
| J693FRM2S2L-54Vk | 285 | EIVLTQSPDFQSVTPKEKVTITCRASQRIGPSLHWYQQKPDQSPKLLIKYASQSISGVPSRFSGSGSGTDFTLTINSLEAEDAATYYCHQNSCLPSTTFGQGTKVEIK |
| J693FRM2S2L-58Vk | 286 | EIVLTQSPDFQSVTPKEKVTITCRASQSIGRSLHWYQQKPDQSPKLLIKYASQSRSGVPSRFSGSGSGTDFTLTINSLEAEDAATYYCHQSGISPPTTFGQGTKVEIK |
| J693FRM2S2L-59Vk | 287 | EIVLTQSPDFQSVTPKEKVTITCRASQSIGTSLHWYQQKPDQSPKLLIKYVSQSISGVPSRFSGSGSGTDFTLTINSLEAEDAATYYCHQGMSSPAPTFGQGTKVEIK |
| J693FRM2S2L-5Vk | 288 | EIVLTQSPDFQSVTPKEKVTITCRASQSIGSSLHWYQQKPDQSPKLLIKYASQSLSGVPSRFSGSGSGTDFTLTINSLEAEDAATYYCHQRRNSPPPTFGQGTKVEIK |
| J693FRM2S2L-88Vk | 289 | EIVLTQSPDFQSVTPKEKVTITCRASQKIGSGLHWYQQKPDQSPKLLIKHASQSISGVPSRFSGSGSGTDFTLTINSLEAEDAATYYCHQNNSSPHKTFGQGTKVEIK |
| J693FRM2S2L-89Vk | 290 | EIVLTQSPDFQSVTPKEKVTITCRASQTIGSNLHWYQQKPDQSPKLLIKHSSQSISGVPSRFSGSGSGTDFTLTINSLEAEDAATYYCHQNSSSPLPTFGQGTKVEIK |

TABLE 12-continued

List of amino acid sequences of affinity matured AE11-5 VL variants

| Clone | SEQ ID NO: | VL |
|---|---|---|
| J693FRM2S2L-8Vk | 291 | EIVLTQSPDFQSVTPKEKVTITCRASQNIGRSLHWYQQKPDQSPKLLIKYASQSSSGVPSRFSGSGSGTDFTLTINSLEAEDAATYYCHQSRSSPPPTFGQGTKVEIK |
| J693FRM2S2L-90Vk | 292 | EIVLTQSPDFQSVTPKEKVTITCRASQCIGKSLHWYQQKPDQSPKLLIKHPSQSVSGVPSRFSGSGSGTDFTLTINSLEAEDAATYYCHQSIGLPPTTFGQGTKVEIK |
| J693FRM2S2L-91Vk | 293 | EIVLTQSPDFQSVTPKEKVTITCRASQTIGSSLHWYQQKPDQSPKLLIKHASQSLSGVPSRFSGSGSGTDFTLTINSLEAEDAATYYCHQSSISPPATFGQGTKVEIK |
| J693FRM2S2L-92Vk | 294 | EIVLTQSPDFQSVTPKEKVTITCRASQSIGSTLHWYQQKPDQSPKLLIKYESQSISGVPSRFSGSGSGTDFTLTINSLEAEDAATYYCHQRCCSPTQTFGQGTKVEIK |
| J693FRM2S2L-94Vk | 295 | EIVLTQSPDFQSVTPKEKVTITCRASQSIGRKLHWYQQKPDQSPKLLIKYSSQSISGVPSRFSGSGSGTDFTLTINSLEAEDAATYYCHQSSRSPPTTFGQGTKVEIK |
| J693FRM2S2R-10Vk | 296 | EIVLTQSPDFQSVTPKEKVTITCRASQTIGTSLHWYQQKPDQSPKLLIKHASQSLSGVPSRFSGSGSGTDFTLTINSLEAEDAATYYCHQSSSPSPTFGQGTKVEIK |
| J693FRM2S2R-11Vk | 297 | EIVLTQSPDFQSVTPKEKVTITCRASQSIGSSLHWYQQKPDQSPKLLIKHVSQSISGVPSRFSGSGSGTDFTLTINSLEAEDAATYYCHQRGSSPPRTFGQGTKVEIK |
| J693FRM2S2R-12Vk | 298 | EIVLTQSPDFQSVTPKEKVTITCRASQTIGSTLHWYQQKPDQSPKLLIKHTSQSISGVPSRFSGSGSGTDFTLTINSLEAEDAATYYCHQRSSSPPPTFGQGTKVEIK |
| J693FRM2S2R-14Vk | 299 | EIVLTQSPDFQSVTPKEKVTITCRASQSIGSNLHWYQQKPDQSPKLLIKHGSQSISGVPSRFSGSGSGTDFTLTINSLEAEDAATYYCHQRHSSPRATFGQGTKVEIK |
| J693FRM2S2R-15Vk | 300 | EIVLTQSPDFQSVTPKEKVTITCRASQKIGSNLHWYQQKPDQSPKLLIKYASQSFSGVPSRFSGSGSGTDFTLTINSLEAEDAATYYCHQNSSSPPATFGQGTKVEIK |
| J693FRM2S2R-16Vk | 301 | EIVLTQSPDFQSVTPKEKVTITCRASQSIGRSLHWYQQKPDQSPKLLIKYASQSISGVPSRFSGSGSGTDFTLTINSLEAEDAATYYCHQSSRSPFRTFGQGTKVEIK |
| J693FRM2S2R-34Vk | 302 | EIVLTQSPDFQSVTPKEKVTITCRASQCIGRRLHWYQQKPDQSPKLLIKHASQSRSGVPSRFSGSGSGTDFTLTINSLEAEDAATYYCHQCTSSPPPTFGQGTKVEIK |
| J693FRM2S2R-36Vk | 303 | EIVLTQSPDFQSVTPKEKVTITCRASQRIGSNLHWYQQKPDQSPKLLIKHASQSISGVPSRFSGSGSGTDFTLTINSLEAEDAATYYCHQSLRLPPQTFGQGTKVEIK |
| J693FRM2S2R-39Vk | 304 | EIVLTQSPDFQSVTPKEKVTITCRASQSIGSSLHWYQQKPDQSPKLLIKHASQSISGVPSRFSGSGSGTDFTLTINSLEAEDAATYYCHQNRSLPRLTFGQGTKVEIK |
| J693FRM2S2R-3Vk | 305 | EIVLTQSPDFQSVTPKEKVTITCRASQSIGSCLHWYQQKPDQSPKLLIKYASQSISGVPSSSVASGSGTDFTLTINSLEAEDAATYYCHQRSSLPQPTFGQGTKVEIK |

TABLE 12-continued

List of amino acid sequences of affinity matured AE11-5 VL variants

| Clone | SEQ ID NO: | VL |
|---|---|---|
| J693FRM2S2R-42Vk | 306 | EIVLTQSPDFQSVTPKEKVTITCRASQSIGRRLHWYQQKPDQSPKLLIKHPSQSVSGVPSRFSGSGSGTDFTLTINSLEAEDAATYYCHQSIDSPPPTFGQGTKVEIK |
| J693FRM2S2R-45Vk | 307 | EIVLTQSPDFQSVTPKEKVTITCRASQTIGRSLHWYQQKPDQSPKLLIKYKSQSSSGVPSRFSGSGSGTDFTLTINSLEAEDAATYYCHQRWGLPMPTFGQGTKVEIK |
| J693FRM2S2R-48Vk | 308 | EIVLTQSPDFQSVTPKEKVTITCRASQRIGSMLHWYQQKPDQSPKLLIKHSSQSISGVPSRFSGSGSGTDFTLTINSLEAEDAATYYCHQTNSLPPRTFGQGTKVEIK |
| J693FRM2S2R-50Vk | 309 | EIVLTQSPDFQSVTPKEKVTITCRASQSIGRSLHWYQQKPDQSPKLLIKHASQSISGVPSRFSGSGSGTDFTLTINSLEAEDAATYYCHQGSRSPLDTFGQGTKVEIK |
| J693FRM2S2R-51Vk | 310 | EIVLTQSPDFQSVTPKEKVTITCRASQSIGCSLHWYQQKPDQSPKLLIKYASQSVSVVPSRFSGSGSGTDFTLTINSLEAEDAATYYCHQSSTLPPPTFGQGTKVEIK |
| J693FRM2S2R-52Vk | 311 | EIVLTQSPDFQSVTPKEKVTITCRASQGIGTSLHWYQQKPDQSPKLLIKHDSQSISGVPSRFSGSGSGTDFTLTINSLEAEDAATYYCHQTSSLPPPTFGQGTKVEIK |
| J693FRM2S2R-56Vk | 312 | EIVLTQSPDFQSVTPKEKVTITCRASQIIGSSLHWYQQKPDQSPKLLIKHASQSISGVPSRFSGSGSGTDFTLTINSLEAEDAATYYCHQSSSLPLPTFGQGTKVEIK |
| J693FRM2S2R-58Vk | 313 | EIVLTQSPDFQSVTPKEKVTITCRASQSIGSSLHWYQQKPDQSPKLLIKYTSQSKSGVPSRFSGSGSGTDFTLTINSLEAEDAATYYCHQGNRSPSTTFGQGTKVEIK |
| J693FRM2S2R-59Vk | 314 | EIVLTQSPDFQSVTPKEKVTITCRASKRIGSSLHWYQQKPDQSPKLLIKHKSQSISGVPSRFSGSGSGTDFTLTINSLEAEDAATYYCHQRSASPPPTFGQGTKVEIK |
| J693FRM2S2R-5Vk | 315 | EIVLTQSPDFQSVTPKEKVTITCRASQTIGSSLHWYQQKPDQSPKLLIKHPSQSMSGVPSRFSGSGSGTDFTLTINSLEAEDAATYYCHQSSTSPPATFGQGTKVEIK |
| J693FRM2S2R-60Vk | 316 | EIVLTQSPDFQSVTPKEKVTITCRASQSIGSSLHWYQQKPDQSPKLLIKHASQSISGVPSRFSGSGSGTDFTLTINSLEAEDAATYYCHQRSSLPTPTFGQGTKVEIK |
| J693FRM2S2R-61Vk | 317 | EIVLTQSPDFQSVTPKEKVTITCRASQSIGSTLHWYQQKPDQSPKLLIKHASQSFSGVPSRFSGSGSGTDFTLTINSLEAEDAATYYCHQSNCSPAHTFGQGTKVEIK |
| J693FRM2S2R-62Vk | 318 | EIVLTQSPDFQSVTPKEKVTITCRASQTIGSRLHWYQQKPDQSPKLLIKYVSQSISGVPSRFSGSGSGTDFTLTINSLEAEDAATYYCHQGSRLPPPTFGQGTKVEIK |
| J693FRM2S2R-63Vk | 319 | EIVLTQSPDFQSVTPKEKVTITCRASQRIGSTLHWYQQKPDQSPKLLIKHASQSNSGVPSRFSGSGSGTDFTLTINSLEAEDAATYYCHQSSCSPQATFGQGTKVEIK |
| J693FRM2S2R-64Vk | 320 | EIVLTQSPDFQSVTPKEKVTITCRASQSIGTSLHWYQQKPDQSPKLLIKYPSQSISGVPSRFSGSGSGTDFTLTINSLEAEDAATYYCHQGSRSPPHTFGQGTKVEIK |

TABLE 12-continued

List of amino acid sequences of affinity matured AE11-5 VL variants

| Clone | SEQ ID NO: | VL |
|---|---|---|
| J693FRM2S2R-65Vk | 321 | EIVLTQSPDFQSVTPKEKVTITCRASQSIGSSLHWYQQKPDQSPKLLIKHASQSISGVPSRFSGSGSGTDFTLTINSLEAEDAATYYCHQNSILPPPTFGQGTKVEIK |
| J693FRM2S2R-92Vk | 322 | EIVLTQSPDFQSVTPKEKVTITCRASQCIGSYLHWYQQKPDQSPKLLIKHVSQSISGVPSRFSGSGSGTDFTLTINSLEAEDAATYYCHQSSSPTLTFGQGTKVEIK |
| J693FRM2S2R-93Vk | 323 | EIVLTQSPDFQSVTPKEKVTITCRASQSIGSSLHWYQQKPDQSPKLLIKHASQSMSGVPSGFSGSGSGTDFTLTINSLEAEDAATYYCHQTNRSPPPTFGQGTKVEIK |
| J693FRM2S2R-9Vk | 324 | EIVLTQSPDFQSVTPKEKVTITCRASQNIGTSLHWYQQKPDQSPKLLIKYVSQSISGVPSRFSGSGSGTDFTLNINSLEAEDAATYYCHQSSCLPRPTFGQGTKVEIK |
| J693M2S2L-10Vk | 325 | EIVLTQSPDFQSVTPKEKVTITCRASQSIGSPLHWYQQKPDQSPKLLIKYASQSISGVPSRFSGSGSGTDFTLTINSLEAEDAATYYCHQGSSSPPPTFGQGTKVEIK |
| J693M2S2L-11Vk | 326 | EIVLTQSPDFQSVTPKEKVTITCRASQSIGSTLHWYQQKPDQSPKLLIKHDSQSKSGVPSRFSGSGSGTDFTLTINSLEAEDAATYYCHQSSDSPAPTFGQGTKVEIK |
| J693M2S2L-12Vk | 327 | EIVLTQSPDFQSVTPKEKVTITCRASQSIGSCLHWYQQKPDQSPKLLIKHASQSNSGVPSRFSGSGSGTDFTLTINSLEAEDAATYYCHQSRISPLPTFGQGTKVEIK |
| J693M2S2L-13Vk | 328 | EIVLTQSPDFQSVTPKEKVTITCRASQSIGRRLHWYQQKPDQSPKLLIKHSSQSISGVPSRFSGSGSGTDFTLTINSLEAEDAATYYCHQCSSLPHPTFGQGTKVEIK |
| J693M2S2L-14Vk | 329 | EIVLTQSPDFQSVTPKEKVTITCRASQRIGSRLHWYQQKPDQSPKLLIKHASQSTSGVPSRFSGSGSGTDFTLTINSLEAEDAATYYCHQCSSPLVTFGQGTKVEIK |
| J693M2S2L-16Vk | 330 | EIVLTQSPDFQSVTPKEKVTITCRASQSIGSRLHWYQQKPDQSPKLLIKHASQSSSGVPSRFSGSGSGTDFTLTINSLEAEDAATYYCHQGSSPQATFGQGTKVEIK |
| J693M2S2L-17Vk | 331 | EIVLTQSPDFQSVTPKEKVTITCRASQSIGSSLHWYQQKPDQSPKLLIKHASQSVSGVPSRFSGSGSGTDFTLTINSLEAEDAATYYCHQNRGSPPQTFGQGTKVEIK |
| J693M2S2L-18Vk | 332 | EIVLTQSPDFQSVTPKEKVTITCRASQTIGSILHWYQQKPDQSPKLLIKHASQSISGVPSRFSGSGSGTDFTLTINSLEAEDAATYYCHQNTSLPPPTFGQGTKVEIK |
| J693M2S2L-19Vk | 333 | EIVLTQSPDFQSVTPKEKVTITCRASQSIGNSLHWYQQKPDQSPKLLIKYPSQSISGVPSRFSGSGSGTDFTLTINSLEAEDAATYYCHQGSRLPVPTFGQGTKVEIK |
| J693M2S2L-1Vk | 334 | EIVLTQSPDFQSVTPKEKVTITCRASQSIGSRLHWYQQKPDQSPKLLIKHTSQSNSGVPSRFSGSGSGTDFTLTINSLEAEDAATYYCHQSSLPAPTFGQGTKVEIK |
| J693M2S2L-20Vk | 335 | EIVLTQSPDFQSVTPKEKVTITCRASQNIGSSLHWYQQKPDQSPKLLIKHVSQSISGVPSRFSGSGSGTDFTLTINSLEAEDAATYYCHQSNSLPAPTFGQGTKVEIK |

TABLE 12-continued

List of amino acid sequences of affinity matured AE11-5 VL variants

| Clone | SEQ ID NO: | VL |
|---|---|---|
| J693M2S2L-21Vk | 336 | EIVLTQSPDFQSVTPKEKVTITCRASQSIGSSLHWYQQKPDQSPKLLIKHASQSISGVPSRFSGSGSGTDFTLTINSLEAEDAATYYCHQSMSLPSATFGQGTKVEIK |
| J693M2S2L-22Vk | 337 | EIVLTQSPDFQSVTPKEKVTITCRASQRIGSSLHWYQQKPDQSPKLLIKHLSQSISGVPSRFSGSGSGTDFTLTINSLEAEDAATYYCHQPCRLPPSTFGQGTKVEIK |
| J693M2S2L-23Vk | 338 | EIVLTQSPDFQSVTPKEKVTITCRASQSIGSLLHWYQQKPDQSPKLLIKHASQSISGVPSRFSGSGSGTDFTLTINSLEAEDAATYYCHQSCSSPRHTFGQGTKVEIK |
| J693M2S2L-24Vk | 339 | EIVLTQSPDFQSVTPKEKVTITCRASQRIGSSLHWYQQKPDQSPKLLIKHPSQSKSGVPSRFSGSGSGTDFTLTINSLEAEDAATYYCHQSSRSPAPTFGQGTKVEIK |
| J693M2S2L-25Vk | 340 | EIVLTQSPDFQSVTPKEKVTITCRASQSIGGSLHWYQQKPDQSPKLLIKYSSQSLSGVPSRFSGSGSGTDFTLTINSLEAEDAATYYCHQSSILPSLTFGQGTKVEIK |
| J693M2S2L-26Vk | 341 | EIVLTQSPDFQSVTPKEKVTITCRASQSIGSSLHWYQQKPDQSPKLLIKHPSQSISGVPSRFSGSGSGTDFTLTINSLEAEDAATYYCHQSRNLPPRTFGQGTKVEIK |
| J693M2S2L-27Vk | 342 | EIVLTQSPDFQSVTPKEKVTITCRASQSIGSILHWYQQKPDQSPKLLIKYGSQSLSGVPSRFSGSGSGTDFTLTINSLEAEDAATYYCHQNGSSPPRTFGQGTKVEIK |
| J693M2S2L-28Vk | 343 | EIVLTQSPDFQSVTPKEKVTITCRASQSIGSSLHWYQQKPDQSPKLLIKYFSQSISGVPSRFSGSGSGTDFTLTINSLEAEDAATYYCHQNSCLPMQTFGQGTKVEIK |
| J693M2S2L-29Vk | 344 | EIVLTQSPDFQSVTPKEKVTITCRASQNIGSSLHWYQQKPDQSPKLLIKYSSQSVSGVPSRFSGSGSGTDFTLTINSLEAEDAATYYCHQSSISPPATFGQGTKVEIK |
| J693M2S2L-2Vk | 345 | EIVLTQSPDFQSVTPKEKVTITCRASQCIGSSLHWYQQKPDQSPKLLIKHASQSNSGVPSRFSGSGSGTDFTLTINSLEAEDAATYYCHQSTCLPPRTFGQGTKVEIK |
| J693M2S2L-30Vk | 346 | EIVLTQSPDFQSVTPKEKVTITCRASQSIGSRLHWYQQKPDQSPKLLIKYVSQSMSGVLSRFSGSGSGTDFTLTINSLEAEDAATYYCHQPSTSPRPTFGQGTKVEIK |
| J693M2S2L-31Vk | 347 | EIVLTQSPDFQSVTPKEKVTITCRASQSIGSRLHWYQQKPDQSPKLLIKHASQSISGVPSRFSGSGSGTDFTLTINSLEAEDAATYYCHQNSSLPPSTFGQGTKVEIK |
| J693M2S2L-32Vk | 348 | EIVLTQSPDFQSVTPKEKVTITCRASQSIGCSLHWYQQKPDQSPKLLIKYASQSNSGVPSRFSGSGSGTDFTLTINSLEAEDAATYYCHQSSSPSSTFGQGTKVEIK |
| J693M2S2L-33Vk | 349 | EIVLTQSPDFQSVTPKEKVTITCRASQIIGTSLHWYQQKPDQSPKLLIKYASQSISGVPSRFSGSGSGTDFTLTINSLEAEDAATYYCHQSRSPPRTFGQGTKVEIK |
| J693M2S2L-34Vk | 350 | EIVLTQSPDFQSVTPKEKVTITCRASQKIGTSLHWYQQKPDQSPKLLIKHESQSISGVPSRFSGSGSGTDFTLTINSLEAEDAATYYCHQSGSPPPTFGQGTKVEIK |

TABLE 12-continued

List of amino acid sequences of affinity matured AE11-5 VL variants

| Clone | SEQ ID NO: | VL |
|---|---|---|
| J693M2S2L-35Vk | 351 | EIVLTQSPDFQSVTPKEKVTITCRASQTIGGSLHWYQQKPDQSPKLLIKHVSQSVSGVPSRFSGSGSGTDFTLTINSLEAEDAATYYCHQSSISPPPTFGQGTKVEIK |
| J693M2S2L-36Vk | 352 | EIVLTQSPDFQSVTPKEKVTITCRASQSIGSDLHWYQQKPDQSPKLLIKHVSQSVSGVPSRFSGSGSGTDFTLTINSLEAEDAATYYCHQSCMSPSLTFGQGTKVEIK |
| J693M2S2L-37Vk | 353 | EIVLTQSPDFQSVTPKEKVTITCRASQSIGSNLHWYQQKPDQSPKLLIKHASQSISGVPSRFSGSGSGTDFTLTINSLEAEDAATYYCHQSSLPNTTFGQGTKVEIK |
| J693M2S2L-38Vk | 354 | EIVLTQSPDFQSVTPKEKVTITCRASQRIGSILHWYQQKPDQSPKLLIKHASQSISGVPSRFSGSGSGTDFTLTINSLEAEDAATYYCHQGRISPSSTFGQGTKVEIK |
| J693M2S2L-39Vk | 355 | EIVLTQSPDFQSVTPKEKVTITCRASQSIGNRLHWYQQKPDQSPKLLIKHASQSLSGVPSRFSGSGSGTDFTLTINSLEAEDAATYYCHQSGSLPTLTFGQGTKVEIK |
| J693M2S2L-3Vk | 356 | EIVLTQSPDFQSVTPKEKVTITCRASQTIGSSLHWYQQKPDQSPKLLIKHDSQSLSGVPSRFSGSGSGTDFTLTINSLEAEDAATYYCHQNSSLPTHTFGQGTKVEIK |
| J693M2S2L-40Vk | 357 | EIVLTQSPDFQSVTPKEKVTITCRASQTIGRSLHWYQQKPDQSPKLLIKHGSQSISGVPSRFSGSGSGTDFTLTINSLEAEDAATYYCHQSRSSPPSTFGQGTKVEIK |
| J693M2S2L-41Vk | 358 | EIVLTQSPDFQSVTPKEKVTITCRASQSIGSSLHWYQQKPDQSPKLLIKYASQSISGVPSRFSGSGSGTDFTLTINSLEAEDAATYYCHQNCSPPPTFGQGTKVEIK |
| J693M2S2L-44Vk | 359 | EIVLTQSPDFQSVTPKEKVTITCRASQSIGSSLHWYQQKPDQSPKLLIKYESQSDSGVPSRFSGSGSGTDFTLTINSLEAEDAATYYCHQRRNSPPSTFGQGTKVEIK |
| J693M2S2L-45Vk | 360 | EIVLTQSPDFQSVTPKEKVTITCRASQGIGSRLHWYQQKPDQSPKLLIKHGSQSISGVPSRFSGSGSGTDFTLTINSLEAEDAATYYCHQNRGLPAPTFGQGTKVEIK |
| J693M2S2L-46Vk | 361 | EIVLTQSPDFQSVTPKEKVTITCRASQSIGSSLHWYQQKPDQSPKLLIKYASQSSSGVPSRFSGSGSGTDFTLTINSLEAEDAATYYCHQNHTSPPPTFGQGTKVEIK |
| J693M2S2L-47Vk | 362 | EIVLTQSPDFQSVTPKEKVTITCRASQSIGSRLHWYQQKPDQSPKLLIKHASQSVSGVPSRFSGSGSGTDFTLTINSLEAEDAATYYCHQSGRLPPPTFGQGTKVEIK |
| J693M2S2L-4Vk | 363 | EIVLTQSPDFQSVTPKEKVTITCRASQYIGKRLHWYQQKPDQSPKLLIKYASQSISGVPSRFSGSGSGTDFTLTINSLEAEDAATYYCHQSNISPPPTFGQGTKVEIK |
| J693M2S2L-51Vk | 364 | EIVLTQSPDFQSVTPKEKVTITCRASQRIGSSLHWYQQKPDQSPKLLIKHESQSISGVPSRFSGSGSGTDFTLTINSLEAEDAATYYCHQSSLPPPTFGQGTKVEIK |
| J693M2S2L-52Vk | 365 | EIVLTQSPDFQSVTPKEKVTITCRASQTIGSSLHWYQQKPDQSPKLLIKYASQSISGVPSRFSGSGSGTDFTLTINSLEAEDAATYYCHQRSSLPPSTFGQGTKVEIK |

TABLE 12-continued

List of amino acid sequences of affinity matured AE11-5 VL variants

| Clone | SEQ ID NO: | VL |
|---|---|---|
| J693M2S2L-54Vk | 366 | EIVLTQSPDFQSVTPKEKVTITCRASQSIGRSLHWYQQKPDQSPKLLIKHPSQSISGVPSRFSGSGSGTDFTLTINSLEAEDAATYYCHQCSSSPAQTFGQGTKVEIK |
| J693M2S2L-55Vk | 367 | EIVLTQSPDFQSVTPKEKVTITCRASQSIGRSLHWYQQKPDQSPKLLIKHTSQSLSGVPSRFSGSGSGTDFTLTINSLEAEDAATYYCHQRSSLPLPTFGQGTKVEIK |
| J693M2S2L-56Vk | 368 | EIVLTQSPDFQSVTPKEKVTITCRASQWIGSSLHWYQQKPDQSPKLLIKHTSQSISGVPSRFSGSGSGTDFTLTINSLEAEDAATYYCHQSSSLPPQTFGQGTKVEIK |
| J693M2S2L-58Vk | 369 | EIVLTQSPDFQSVTPKEKVTITCRASQSIGRSLHWYQQKPDQSPKLLIKYSSQSISGVPSRFSGSGSGTDFTLTINSLEAEDAATYYCHQGSSPPPTFGQGTKVEIK |
| J693M2S2L-59Vk | 370 | EIVLTQSPDFQSVTPKEKVTITCRASQSIGSSLHWYQQKPDQSPKLLIKHASQSISGVPSRFSGSGSGTDFTLTINSLEAEDAATYYCHQSSRLPPSTFGQGTKVEIK |
| J693M2S2L-5Vk | 371 | EIVLTQSPDFQSVTPKEKVTITCRASQSIGSSLHWYQQKPDQSPKLLIKYGSQSISGVPSRFSGSGSGTDFTLTINSLEAEDAATYYCHQNWSLPLPTFGQGTKVEIK |
| J693M2S2L-62Vk | 372 | EIVLTQSPDFQSVTPKEKVTITCRASQRIGTSLHWYQQKPDQSPKLLIKYASQSKSGVPSRFSGSGSGTDFTLTINSLEAEDAATYYCHQSSCSPTPTFGQGTKVEIK |
| J693M2S2L-64Vk | 373 | EIVLTQSPDFQSVTPKEKVTITCRASQSIGGSLHWYQQKPDQSPKLLIKYGSQSISGVPSRFSGSGSGTDFTLTINSLEAEDAATYYCHQRCVSPSPTFGQGTKVEIK |
| J693M2S2L-65Vk | 374 | EIVLTQSPDFQSVTPKEKVTITCRASQSIGGTLHWYQQKPDQSPKLLIKYASQSISGVPSRFSGSGSGTDFTLTINSLEAEDAATYYCHQSSSPARTFGQGTKVEIK |
| J693M2S2L-66Vk | 375 | EIVLTQSPDFQSVTPKEKVTITCRASQSIGSSLHWYQQKPDQSPKLLIKYASQSISGVPSRFSGSGSGTDFTLTINSLEAEDAATYYCHQCGSSPLHTFGQGTKVEIK |
| J693M2S2L-67Vk | 376 | EIVLTQSPDFQSVTPKEKVTITCRASQSIGTSLHWYQQKPDQSPKLLIKHPSQSLSGVPSRFSGSGSGTDFTLTINSLEAEDAATYYCHQSTSSPPPTFGQGTKVEIK |
| J693M2S2L-68Vk | 377 | EIVLTQSPDFQSVTPKEKVTITCRASQNIGSSLHWYQQKPDQSPKLLIKHASQSISGVPSRFSGSGSGTDFTLTINSLEAEDAATYYCHQNSGLPLPTFGQGTKVEIK |
| J693M2S2L-69Vk | 378 | EIVLTQSPDFQSVTPKEKVTITCRASQSIGRRLHWYQQKPDQSPKLLIKYASQSISGVPSRFSGSGSGTDFTLTINSLEAEDAATYYCHQGSSPSPTFGQGTKVEIK |
| J693M2S2L-6Vk | 379 | EIVLTQSPDFQSVTPKEKVTITCRASQRIGGNLHWYQQKPDQSPKLLIKHESQSNSGVPSRFSGSGSGTDFTLTINSLEAEDAATYYCHQSSSLPSHTFGQGTKVEIK |
| J693M2S2L-70Vk | 380 | EIVLTQSPDFQSVTPKEKVTITCRASQSIGSSLHWYQQKPDQSPKLLIKYASQSTSGVPSRFSGSGSGTDFTLTINSLEAEDAATYYCHQCSSSPSHTFGQGTKVEIK |

TABLE 12-continued

List of amino acid sequences of affinity matured AE11-5 VL variants

| Clone | SEQ ID NO: | VL |
|---|---|---|
| J693M2S2L-71Vk | 381 | EIVLTQSPDFQSVTPKEKVTITCRASQSIGSSLHWYQQKPDQSPKLLIKHASQSMSGVPSRFSGSGSGTDFTLTINSLEAEDAATYYCHQSRNSPPTTFGQGTKVEIK |
| J693M2S2L-72Vk | 382 | EIVLTQSPDFQSVTPKEKVTITCRASQRIGSRLHWYQQKPDQSPKLLIKHGSQSISGVPSRFSGSGSGTDFTLTINSLEAEDAATYYCHQNSSSPPPTFGQGTKVEIK |
| J693M2S2L-74Vk | 383 | EIVLTQSPDFQSVTPKEKVTITCRASQNIGSSLHWYQQKPDQSPKLLIKYASQSLSGVPSRFSGSGSGTDFTLTINSLEAEDAATYYCHQSSLLPAPTFGQGTKVEIK |
| J693M2S2L-75Vk | 384 | EIVLTQSPDFQSVTPKEKVTITCRASQIIGTTLHWYQQKPDQSPKLLIKHASQSISGVPSRFSGSGSGTDFTLTINSLEAEDAATYYCHQNSNLPPSTFGQGTKVEIK |
| J693M2S2L-76Vk | 385 | EIVLTQSPDFQSVTPKEKVTITCRASQNIGGNLHWYQQKPDQSPKLLIKHASQSLSGVPSRFSGSGSGTDFTLTINSLEAEDAATYYCHQSSNLPPPTFGQGTKVEIK |
| J693M2S2L-77Vk | 386 | EIVLTQSPDFQSVTPKEKVTITCRASQGIGGSLHWYQQKPDQSPKLLIKYASQSTSGVPSRFSGSGSGTDFTLTINSLEAEDAATYYCHQSACLPTRTFGQGTKVEIK |
| J693M2S2L-78Vk | 387 | EIVLTQSPDFQSVTPKEKVTITCRASQSIGTSLHWYQQKPDQSPKLLIKYASQSVSGVPSRFSGSGSGTDFTLTINSLEAEDAATYYCHQIGSLPPPTFGQGTKVEIK |
| J693M2S2R-13Vk | 388 | EIVLTQSPDFQSVTPKEKVTITCRASQSIGRSLHWYQQKPDQSPKLLIKHASQSVSGVPSRFSGSGSGTDFTLTINSLEAEDAATYYCHQNSRLPPPTFGQGTKVEIK |
| J693M2S2R-14Vk | 389 | EIVLTQSPDFQSVTPKEKVTITCRASQSIGSSLHWYQQKPDQSPKLLIKHNSQSISGVPSRFSGSGSGTDFTLTINSLEAEDAATYYCHQRSSPPLTFGQGTKVEIK |
| J693M2S2R-15Vk | 390 | EIVLTQSPDFQSVTPKEKVTITCRASQSIGRNLHWYQQKPDQSPKLLIKHVSQSISGVPSRFSGSGSGTDFTLTINSLEAEDAATYYCHQRSRSPPSTFGQGTKVEIK |
| J693M2S2R-16Vk | 391 | EIVLTQSPDFQSVTPKEKVTITCRASQSIGSSLHWYQQKPDQSPKLLIKHASQSVSGVPSRFSGSGSGTDFTLTINSLEAEDAATYYCHQCSSLPAPTFGQGTKVEIK |
| J693M2S2R-17Vk | 392 | EIVLTQSPDFQSVTPKEKVTITCRASQRIGSSLHWYQQKPDQSPKLLIKHASQSLSGVPSRFSGSGSGTDFTLTINSLEAEDAATYYCHQSSRLPPQTFGQGTKVEIK |
| J693M2S2R-18Vk | 393 | EIVLTQSPDFQSVTPKEKVTITCRASQCIGSRLHWYQQKPDQSPKLLIKYASQSISGVPSRFSGSGSGTDFTLTINSLEAEDAATYYCHQRGRLPPRTFGQGTKVEIK |
| J693M2S2R-19Vk | 394 | EIVLTQSPDFQSVTPKEKVTITCRASQSIGSSLHWYQQKPDQSPKLLIKYASQSISGVPSRFSGSGSGTDFTLTINSLEAEDAATYYCHQSTSLPRLTFGQGTKVEIK |
| J693M2S2R-20Vk | 395 | EIVLTQSPDFQSVTPKEKVTITCRASQIIGSSLHWYQQKPDQSPKLLIKYASQSISGVPSRFSGSGSGTDFTLTINSLEAEDAATYYCHQSRSSPQQTFGQGTKVEIK |

TABLE 12-continued

List of amino acid sequences of affinity matured AE11-5 VL variants

| Clone | SEQ ID NO: | VL |
|---|---|---|
| J693M2S2R-21Vk | 396 | EIVLTQSPDFQSVTPKEKVTITCRASQSIGSTLHWYQQKPDQSPKLLIKHASQSISGVPSRFSGSGSGTDFTLTINSLEAEDAATYYCHQSSSLPPPTFGQGTKVEIK |
| J693M2S2R-22Vk | 397 | EIVLTQSPDFQSVTPKEKVTITCRASQSIGNSLHWYQQKPDQSPKLLIKHGSQSISGVPSRFSGSGSGTDFTLTINSLEAEDAATYYCHQRRSSPRHTFGQGTKVEIK |
| J693M2S2R-27Vk | 398 | EIVLTQSPDFQSVTPKEKVTITCRASQRIGRRLHWYQQKPDQSPKLLIKHASQSISGVPSRFSGSGSGTDFTLTINSLEAEDAATYYCHQSIGSPPLTFGQGTKVEIK |
| J693M2S2R-29Vk | 399 | EIVLTQSPDFQSVTPKEKVTITCRASQSIGRGLHWYQQKPDQSPKLLIKYGSQSMSGVPSRFSGSGSGTDFTLTINSLEAEDAATYYCHQSSSLPPPTFGQGTKVEIK |
| J693M2S2R-2Vk | 400 | EIVLTQSPDFQSVTPKEKVTITCRASQSIGCSLHWYQQKPDQSPKLLIKYASQSISGVPSRFSGSGSGTDFTLTINSLEAEDAATYYCHQCTSLPLPTFGQGTKVEIK |
| J693M2S2R-30Vk | 401 | EIVLTQSPDFQSVTPKEKVTITCRASQGIGSSLHWYQQKPDQSPKLLIKYVSQSISGVPSRFSGSGSGTDFTLTINSLEAEDAATYYCHQGSSLPTPTFGQGTKVEIK |
| J693M2S2R-31Vk | 402 | EIVLTQSPDFQSVTPKEKVTITCRASQSIGTSLHWYQQKPDQSPKLLIKHASQSSSGVPSRFSGSGSGTDFTLTINSLEAEDAATYYCHQSSRLPPLTFGQGTKVEIK |
| J693M2S2R-32Vk | 403 | EIVLTQSPDFQSVTPKEKVTITCRASQVIGGVLHWYQQKPDQSPKLLIKYTSQSISGVPSRFSGSGSGTDFTLTINSLEAEDAATYYCHQSSSPRPTFGQGTKVEIK |
| J693M2S2R-33Vk | 404 | EIVLTQSPDFQSVTPKEKVTITCRASQSIGSSLHWYQQKPDQSPKLLIKHSSQSLSGVPSRFSGSGSGTDFTLTINSLEAEDAATYYCHQRSNSPHRTFGQGTKVEIK |
| J693M2S2R-36Vk | 405 | EIVLTQSPDFQSVTPKEKVTITCRASQSIGRTLHWYQQKPDQSPKLLIKYASQSISGVPSRFSGSGSGTDFTLTINSLEAEDAATYYCHQCSISPQPTFGQGTKVEIK |
| J693M2S2R-37Vk | 406 | EIVLTQSPDFQSVTPKEKVTITCRASQRIGNTLHWYQQKPDQSPKLLIKYPSQSISGVPSRFSGSGSGTDFTLTINSLEAEDAATYYCHQSGSSPPPTFGQGTKVEIK |
| J693M2S2R-39Vk | 407 | EIVLTQSPDFQSVTPKEKVTITCRASQSIGSRLHWYQQKPDQSPKLLIKYISQSMSGVPSRFSGSGSGTDFTLTINSLEAEDAATYYCHQSCGLPPPTFGQGTKVEIK |
| J693M2S2R-3Vk | 408 | EIVLTQSPDFQSVTPKEKVTITCRASQNIGTRLHWYQQKPDQSPKLLIKYGSQSLSGVPSRFSGSGSGTDFTLTINSLEAEDAATYYCHQSRISPPPTFGQGTKVEIK |
| J693M2S2R-40Vk | 409 | EIVLTQSPDFQSVTPKEKVTITCRASQSIGSTLHWYQQKPDQSPKLLIKYVSQSISGVPSRFSGSGSGTDFTLTINSLEAEDAATYYCHQCSRLPPPTFGQGTKVEIK |
| J693M2S2R-44Vk | 410 | EIVLTQSPDFQSVTPKEKVTITCRASQSIGSRLHWYQQKPDQSPKLLIKYASQSTSGVPSRFSGSGSGTDFTLTINSLEAEDAATYYCHQSSNLPSPTFGQGTKVEIK |

TABLE 12-continued

List of amino acid sequences of affinity matured AE11-5 VL variants

| Clone | SEQ ID NO: | VL |
|---|---|---|
| J693M2S2R-45Vk | 411 | EIVLTQSPDFQSVTPKEKVTITCRASQSIGSNLHWYQQKPDQSPKLLIKHASQSMSGVPSRFSGSGSGTDFTLTINSLEAEDAATYYCHQSSSLPRPTFGQGTKVEIK |
| J693M2S2R-46Vk | 412 | EIVLTQSPDFQSVTPKEKVTITCRASQIIGSSLHWYQQKPDQSPKLLIKYASQSISGVPSRFSGSGSGTDFTLTINSLEAEDAATYYCHQSISSPSPTFGQGTKVEIK |
| J693M2S2R-47Vk | 413 | EIVLTQSPDFQSVTPKEKVTITCRASQSIGSSLHWYQQKPDQSPKLLIKYASQSFSGVPSRFSGSGSGTDFTLTINSLEAEDAATYYCHQSNCLPPPTFGQGTKVEIK |
| J693M2S2R-48Vk | 414 | EIVLTQSPDFQSVTPKEKVTITCRASQSIGKSLHWYQQKPDQSPKLLIKHESQSISGVPSRFSGSGSGTDFTLTINSLEAEDAATYYCHQANSLPPPTFGQGTKVEIK |
| J693M2S2R-4Vk | 415 | EIVLTQSPDFQSVTPKEKVTITCRASQSIGRRLHWYQQKPDQSPKLLIKYASQSISGVPSRFSGSGSGTDFTLTINSLEAEDAATYYCHQCSSPPSTFGQGTKVEIK |
| J693M2S2R-52Vk | 416 | EIVLTQSPDFQSVTPKEKVTITCRASQIIGHSLHWYQQKPDQSPKLLIKHASQSILGVPSRFSGSGSGTDFTLTINSLEAEDAATYYCHQSIKSPPATFGQGTKVEIK |
| J693M2S2R-54Vk | 417 | EIVLTQSPDFQSVTPKEKVTITCRASQSIGTSLHWYQQKPDQSPKLLIKHTSQSKSGVPSRFSGSGSGTDFALTINSLEAEDAATYYCHQSSNSPRYTFGQGTKVEIK |
| J693M2S2R-55Vk | 418 | EIVLTQSPDFQSVTPKEKVTITCRASQSIGSSLHWYQQKPDQSPKLLIKHASQSHSGVPSRFSGSGSGTDFTLTINSLEAEDAATYYCHQSGGSPPWTFGQGTKVEIK |
| J693M2S2R-56Vk | 419 | EIVLTQSPDFQSVTPKEKVTITCRASQGIGRSLHWYQQKPDQSPKLLIKYASQSLSGVPSRFSGSGSGTDFTLTINSLEAEDAATYYCHQSNRSPPPTFGQGTKVEIK |
| J693M2S2R-5Vk | 420 | EIVLTQSPDFQSVTPKEKVTITCRASQSIGTTLHWYQQKPDQSPKLLIKHVSQSTSGVPSRFSGSGSGTDFTLTINSLEAEDAATYYCHQSSSLPHPTFGQGTKVEIK |
| J693M2S2R-60Vk | 421 | EIVLTQSPDFQSVTPKEKVTITCRASQIIGSSLHWYQQKPDQSPKLLIKYPSQSTSGVPSRFSGSGSGTDFTLTINSLEAEDAATYYCHQSWSSPLMTFGQGTKVEIK |
| J693M2S2R-61Vk | 422 | EIVLTQSPDFQSVTPKEKVTITCRASQSIGNTLHWYQQKPDQSPKLLIKHASQSISGVPSRFSGSGSGTDFTLTINSLEAEDAATYYCHQSSSPPPTFGQGTKVEIK |
| J693M2S2R-62Vk | 423 | EIVLTQSPDFQSVTPKEKVTITCRASQRIGICLHWYQQKPDQSPKLLIKYASQSMSGVPSRFSGSGSGTDFTLTINSLEAEDAATYYCHQGFSLPPATFGQGTKVEIK |
| J693M2S2R-63Vk | 424 | EIVLTQSPDFQSVTPKEKVTITCRASQSIGSCLHWYQQKPDQSPKLLIKYPSQSTSGVPSRFSGSGSGTDFTLTINSLEAEDAATYYCHQGSCSPTTTFGQGTKVEIK |
| J693M2S2R-64Vk | 425 | EIVLTQSPDFQSVTPKEKVTITCRASQRIGNTLHWYQQKPDQSPKLLIKYPSQSISGVPSRFSGSGSGTDFTLTINSLEAEDAATYYCHQGSSPPPTFGQGTKVEIK |

TABLE 12-continued

List of amino acid sequences of affinity matured AE11-5 VL variants

| Clone | SEQ ID NO: | VL |
|---|---|---|
| J693M2S2R-65Vk | 426 | EIVLTQSPDFQSVTPKEKVTITCRASQTIGTSLHWYQQKPDQSPKLLIKYASQSTSGVPSRFSGSGSGTDFTLTINSLEAEDAATYYCHQRCSLPPPTFGQGTKVEIK |
| J693M2S2R-68Vk | 427 | EIVLTQSPDFQSVTPKEKVTITCRASQSIGGSLHWYQQKPDQSPKLLIKYASQSHSGVPSRFSGSGSGTDFTLTINSLEAEDAATYYCHQCRISPRPTFGQGTKVEIK |
| J693M2S2R-69Vk | 428 | EIVLTQSPDFQSVTPKEKVTITCRASQRIGSSLHWYQQKPDQSPKLLIKHPSQSKSGVPSRFSGSGSGTDFTLSINSLEAEDAATYYCHQTSRSPLHTFGQGTKVEIK |
| J693M2S2R-6Vk | 429 | EIVLTQSPDFQSVTPKEKVTITCRASQNIGKNLHWYQQKPDQSPKLLIKYPSQSISGVPSRFSGSGSGTDFTLTINSLEAEDAATYYCHQRSSPLSTFGQGTKVEIK |
| J693M2S2R-70Vk | 430 | EIVLTQSPDFQSVTPKEKVTITCRASQSIGSRLHWYQQKPDQSPKLLIKYMSQSISGVPSRFSGSGSGTDFTLTINSLEAEDAATYYCHQSRVLPPPTFGQGTKVEIK |
| J693M2S2R-71Vk | 431 | EIVLTQSPDFQSVTPKEKVTITCRASQSIGSSLHWYQQKPDQSPKLLIKYGSQSISGVPSRFSGSGSGTDFTLTINSLEAEDAATYYCHQSSISPRRTFGQGTKVEIK |
| J693M2S2R-72Vk | 432 | EIVLTQSPDFQSVTPKEKVTITCRASQTIGRSLHWYQQKPDQSPKLLIKYASQSISGVPSRFSGSGSGTDFTLTINSLEAEDAATYYCHQRKSSPTPTFGQGTKVEIK |
| J693M2S2R-75Vk | 433 | EIVLTQSPDFQSVTPKEKVTITCRASQRIGRQLHWYQQKPDQSPKLLIKHPSQSISGVPSRFSGSGSGTDFTLTINSLEAEDAATYYCHQSSSLPPQTFGQGTKVEIK |
| J693M2S2R-77Vk | 434 | EIVLTQSPDFQSVTPKEKVTITCRASQSIGSSLHWYQQKPDQSPKLLIKHTSQSISGVPSRFSGSGSGTDFTLTINSLEAEDAATYYCHQICRSPSPTFGQGTKVEIK |
| J693M2S2R-78Vk | 435 | EIVLTQSPDFQSVTPKEKVTITCRASQSIGSSLHWYQQKPDQSPKLLIKYASQSSSGVPSRFSGSGSGTDFTLTINSLEAEDAATYYCHQSSGSPAPTFGQGTKVEIK |
| J693M2S2R-79Vk | 436 | EIVLTQSPDFQSVTPKEKVTITCRASQSIGSSLHWYQQKPDQSPKLLIKYSSQSTSGVPSRFSGSGSGTDFTLTINSLEAEDAATYYCHQISSSPPPTFGQGTKVEIK |
| J693M2S2R-7Vk | 437 | EIVLTQSPDFQSVTPKEKVTITCRASQTIGNSLHWYQQKPDQSPKLLIKHASQSNSGVPSRFSGSGSGTDFTLTINSLEAEDAATYYCHQTMTSPPPTFGQGTKVEIK |
| J693M2S2R-80Vk | 438 | EIVLTQSPDFQSVTPKEKVTITCRASQSIGSSLHWYQQKPDQSPKLLIKHASQSISGVPSRFSGSGSGTDFTLTINSLEAEDAATYYCHQSRSSPSPTFGQGTKVEIK |
| J693M2S2R-81Vk | 439 | EIVLTQSPDFQSVTPKEKVTITCRASQSIGSSLHWYQQKPDQSPKLLIKHASQSISGVPSRFSGSGSGTDFTLTINSLEAEDAATYYCHQRRWSPPPTFGQGTKVEIK |
| J693M2S2R-82Vk | 440 | EIVLTQSPDFQSVTPKEKVTITCRASQSIGSSLHWYQQKPDQSPKLLIKYASQSNSGVPSRFSGSGSGTDFTLTINSLEAEDAATYYCHQISCLPLPTFGQGTKVEIK |

TABLE 12-continued

List of amino acid sequences of affinity matured AE11-5 VL variants

| Clone | SEQ ID NO: | VL |
|---|---|---|
| J693M2S2R-83Vk | 441 | EIVLTQSPDFQSVTPKEKVTITCRASQRIGSSLHWYQQKPDQSPKLLIKHASQSISGVPSRFSGSGSGTDFTLTINSLEAEDAATYYCHQSISLPPPTFGQGTKVEIK |
| J693M2S2R-84Vk | 442 | EIVLTQSPDFQSVTPKEKVTITCRASQSIGRNLHWYQQKPDQSPKLLIKHTSQSLSGVPSRFSGSGSGTDFTLTINSLEAEDAATYYCHQTSTLPPQTFGQGTKVEIK |
| J693M2S2R-85Vk | 443 | EIVLTQSPDFQSVTPKEKVTITCRASQSIGRSLHWYQQKPDQSPKLLIKYASQSISGVPSRFSGSGSGTDFTLTINSLEAEDAATYYCHQSRNSPQPTFGQGTKVEIK |
| J693M2S2R-86Vk | 444 | EIVLTQSPDFQSVTPKEKVTITCRASQSIGTRLHWYQQKPDQSPKLLIKYVSQSISGVPSRFSGSGSGTDFTLTINSLEAEDAATYYCHQSSHSPPPTFGQGTKVEIK |
| J693M2S2R-87Vk | 445 | EIVLTQSPDFQSVTPKEKVTITCRASQSIGSCLHWYQQKPDQSPKLLIKHRSQSISGVPSRFSGSGSGTDFTLTINSLEAEDAATYYCHQWSSSPPPTFGQGTKVEIK |
| J693M2S2R-89Vk | 446 | EIVLTQSPDFQSVTPKEKVTITCRASQRIGSSLHWYQQKPDQSPKLLIKHPSQSISGVPSRFSGSGSGTDFTLTINSLEAEDAATYYCHQTSGSPSHTFGQGTKVEIK |
| J693M2S2R-8Vk | 447 | EIVLTQSPDFQSVTPKEKVTITCRASQGIGSSLHWYQQKPDQSPKLLIKYESQSISGVPSRFSGSGSGTDFTLTINSLEAEDAATYYCHQSSSPPPTFGQGTKVEIK |
| J693M2S2R-90Vk | 448 | EIVLTQSPDFQSVTPKEKVTITCRASQSIGSSLHWYQQKPDQSPKLLIKHDSQSISGVPSRFSGSGSGTDFTLTINSLEAEDAATYYCHQGSSSPPTTFGQGTKVEIK |
| J693M2S2R-91Vk | 449 | EIVLTQSPDFQSVTPKEKVTITCRASQTIGSNLHWYQQKPDQSPKLLIKHASQSISGVPSRFSGSGSGTDFTLTINSLEAEDAATYYCHQRISSPPSTFGQGTKVEIK |
| J693M2S2R-92Vk | 450 | EIVLTQSPDFQSVTPKEKVTITCRASQTIGSSLHWYQQKPDQSPKLLIKHASQSVSGVPSRFSGSGSGTDFTLTINSLEAEDAATYYCHQSCSSPPSTFGQGTKVEIK |
| J693M2S2R-93Vk | 451 | EIVLTQSPDFQSVTPKEKVTITCRASQTIGSSLHWYQQKPDQSPKLLIKYVSQSLSGVPSRFSGSGSGTDFTLTINSLEAEDAATYYCHQTISSPLPTFGQGTKVEIK |
| J693M2S2R-95Vk | 452 | EIVLTQSPDFQSVTPKEKVTITCRASQSIGSRLHWYQQKPDQSPKLLIKHASQSISGVPSRFSGSGSGTDFTLTINSLEAEDAATYYCHQSSCSPAHTFGQGTKVEIK |
| J703M1S3-11Vk | 453 | EIVLTQSPDFQSVTPKEKVTITCRDSRCIGSNLHWYQQKPDQSPKLLIKHASQSSSGVPSRFSGSGSGTDFTLTINSLEAEDAATYYCHQCSSPPPTFGQGTKVEIK |
| J703M1S3-13Vk | 454 | EIVLTQSPDFQSVTPKEKVTITCRASQSIGSTLHWYQQKPDQSPKLLIKHASQSNSGVPSRFSGSGSGTDFTLTINSLEAEDAATYYCHQSSSLPPPTFGQGTKVEIK |
| J703M1S3-16Vk | 455 | EIVLTQSPDFQSVTPKEKVTITCRASQSIGDSLHWYQQKPDQSPKLLIKHASQSKSGVPSRFSGSGSGTDFTLTINSLEAEDAATYYCHQGSTSPPRTFGQGTKVEIK |

TABLE 12-continued

List of amino acid sequences of affinity matured AE11-5 VL variants

| Clone | SEQ ID NO: | VL |
|---|---|---|
| J703M1S3-19Vk | 456 | EIVLTQSPDFQSVTPKEKVTITCRASQSIGSSLHWYQQKPDQSPKLLIKHGSQSSSGVPSRFSGSGSGTDFTLTINSLEAEDAATYYCHQSWSSPIPTFGQGTKVEIK |
| J703M1S3-22Vk | 457 | EIVLTQSPDFQSVTPKEKVTITCRASQSIGSRLHWYQQKPDQSPKLLIKYASQSTSGVPSRFSGSGSGTDFTLTINSLEAEDAATYYCHQSSNLPSPTFGQGTKVEIK |
| J703M1S3-26Vk | 458 | EIVLTQSPDFQSVTPKEKVTITCRASQSIGSRLHWYQQKPDQSPKLLIKHASQSTSGVPSRFSGSGSGTDFTLTINSLEAEDAATYYCHQSGSSPPRTFGQGTKVEIK |
| J703M1S3-29Vk | 459 | EIVLTQSPDFQSVTPKEKVTITCRASQSIGSSLHWYQQKPDQSPKLLIKHASQSISGVPSRFSGSGSGTDFTLTINSLEAEDAATYYCHQRTSSPVRTFGQGTKVEIK |
| J703M1S3-2Vk | 460 | EIVLTQSPDFQSVTPKEKVTITCRASQSIGNTLHWYQQKPDQSPKLLIKHVSQSVSGVPSRFSGSGSGTDFTLTINSLEAEDAATYYCHQKVSSPSPTFGQGTKVEIK |
| J703M1S3-30Vk | 461 | EIVLTQSPDFQSVTPKEKVTITCRASQRIGSSLHWYQQKPDQSPKLLIKHASQSVSGVPSRFSGSGSGTDFTLTINSLEAEDAATYYCHQSRSSPPPTFGQGTKVEIK |
| J703M1S3-33Vk | 462 | EIVLTQSPDFQSVTPKEKVTITCRASQSIGSSLHWYQQKPDQSPKLLIKHASQSTSGVPSRFSGSGSGTDFTLTINSLEAEDAATYYCHQSSSPPSTFGQGTKVEIK |
| J703M1S3-34Vk | 463 | EIVLTQSPDFQSVTPKEKVTITCRASQSIGSSLHWYQQKPDQSPKLLIKYASQSISGVPSRFSGSGSGTDFTLTINSLEAEDAATYYCHQNSSSPSTTFGQGTKVEIK |
| J703M1S3-57Vk | 464 | EIVLTQSPDFQSVTPKEKVTITCRASQCIGSSLHWYQQKPDQSPKLLIKHESQSSSGVPSRFSGSGSGTDFTLTINSLEAEDAATYYCHQRCTSPSPTFGQGTKVEIK |
| J703M1S3-5Vk | 465 | EIVLTQSPDFQSVTPKEKVTITCRASQRIGSSLHWYQQKPDQSPKLLIKHPSQSDSGVPSRFSGSGSGTDFTLTINSLEAEDAATYYCHQNCSLPLPTFGQGTKVEIK |
| J703M1S3-62Vk | 466 | EIVLTQSPDFQSVTPKEKVTITCRASQCIGSSLHWYQQKPDQSPKLLIKHASQSTSGVPSRFSGSGSGTDFTLTINSLEAEDAATYYCHQGISSPPQTFGQGTKVEIK |
| J703M1S3-69Vk | 467 | EIVLTQSPDFQSVTPKEKVTITCRASQSIGSSLHWYQQKPDQSPKLLIKHVSQSLSGVPSRFSGSGSGTDFTLTINSLEAEDAATYYCHQRSSPSPTFGQGTKVEIK |
| J703M1S3-71Vk | 468 | EIVLTQSPDFQSVTPKEKVTITCRASQSIGSSLHWYQQKPDQSPKLLIKHPSQSLSGVPSRFSGSGSGTDFTLTINSLEAEDAATYYCHQSIRLPPSTFGQGTKVEIK |
| J703M1S3-78Vk | 469 | EIVLTQSPDFQSVTPKEKVTITCRANQSIGGSLHWYQQKPDQSPKLLIKHASQSKSGVPSRFSGSGSGTDFTLTINSLEAEDAATYYCHQDSRSPTRTFGQGTKVEIK |
| J703M1S3-79Vk | 470 | EIVLTQSPDFQSVTPKEKVTITCRASQSIGSGLHWYQQKPDQSPKLLIKHTSQSISGVPSRFSGSGSGTDFTLTINSLEAEDAATYYCHQSSSLPHPTFGQGTKVEIK |

TABLE 12-continued

List of amino acid sequences of affinity matured AE11-5 VL variants

| Clone | SEQ ID NO: | VL |
|---|---|---|
| J703M1S3-7Vk | 471 | EIVLTQSPDFQSVTPKEKVTITCRASQSIGSSLHWYQQKPDQSPKLLIKHASQSTSGVPSRFSGSGSGTDFTLTINSLEAEDAATYYCHQSSSSPTPTFGQGTKVEIK |
| J703M1S3-81Vk | 472 | EIVLTQSPDFQSVTPKEKVTITCRASQSIGSRLHWYQQKPDQSPKLLIKYPSQSRSGVPSRFSGSGSGTDLTLTINSLEAEDAATYYCHQNGSLPPPTFGQGTKVEIK |
| J703M1S3-82Vk | 473 | EIVLTQSPDFQSVTPKEKVTITCRASQSIGSSLHWYQQKPDQSPKLLIKHASQSISGVPSRFSGSGSGTDFTLTINSLEAEDAATYYCHQNSSSPPPTFGQGTKVEIK |
| J703M1S3-86Vk | 474 | EIVLTQSPDFQSVTPKEKVTITCRASQSIGSALHWYQQKPDQSPKLLIKHASQSLSGVPSRFSGSGSGTDFTLTINSLEAEDAATYYCHQSSILPRPTFGQGTKVEIK |
| J703M1S3-90Vk | 475 | EIVLTQSPDFQSVTPKEKVTITCRASQSIGSNLHWYQQKPDQSPKLLIKHASQSISGVPSRFSGSGSGTDFTLTINSLEAEDAATYYCHQTRTSPPLTFGQGTKVEIK |
| J703M1S3-93Vk | 476 | EIVLTQSPDFQSVTPKEKVTITCRASQKIGSSLHWYQQKPDQSPKLLIKYGSQSTSGVPSRFSGSGSGTDFTLTINSLEAEDAATYYCHQCISLPTPTFGQGTKVEIK |
| J703M1S3-94Vk | 477 | EIVLTQSPDFQSVTPKEKVAITCRASQRIGSSLHWYQQKPDQSPKLLIKYASQSISGVPSRFSGSGSGTDFTLTINSLEAEDAATYYCHQNSSLPPPTFGQGTKVEIK |

TABLE 13

Amino acid residues observed in affinity matured AE11-5 antibodies

AE11-5 Heavy chain variable region (SEQ ID NO: 1073)

```
AE11-5VH 12345678901234567890123456789012345678901234567890123456789012a345678901
         EVQLVQSGAEVKKPGSSAKVSCKASGGTFSSYAISWVRQAPGQGLEWMGGIIPILGTANYAQ
                                   V             NW TTT             WT  FRSPI
                                                 TY SV              M   TDAST
                                                 GI P               L   I NGS
                                                 AN G               V   P  V
                                                 F                  N   I  H
                                                 R                      V  A
                                                 L                      K  R
                                                                        F  M
                                                                           L 23456789012345678901 2abc345678901234567890abc1234567890123
         KFLGRVTITADESTSTVYMELSSLRSEDTAVYYCARGLYYDPTRADYWGQGTLVTVSS
             Q               A                  SVFFNTSWF
                                                WIVVEFASM
                                                TFP TRKP
                                                ARH IGRA
                                                Q   ADI
                                                      Y
                                                      V
                                                      P
                                                      N
                                                      G
```

AE11-5 Light chain variable region (SEQ ID NO: 1074)

```
AE11-5VL 12345678901234567890123456789012345678901234567890123456789012345678901
         DIVMTQSPDFHSVTPKEKVTITCRASQSIGSSLHWYQQKPDQSPKLLIRHASQSISGVPSR
            E   L             Q       R RR                   KYV  L
                                      T TT                   P    V
```

TABLE 13-continued

Amino acid residues observed in affinity matured AE11-5 antibodies

```
                                    N    GN              T    T
                                    I    NC              G    S
                                    C    KG              S    M
                                    G    CI              E    N
                                    K    HK              D    K
                                    Y    VM                   F
                                    W    PL                   R
                                         LY
                                         P
                                         V
          23456789012345678901234567890123453a67890123456a
          FSGSGSGTDFTLTIHSLEAEDAATYYCHQSSSSPPPTFGQTQVEIK
                        N              RRRL LS         K
                                       NGI  AR
                                       GIC  SL
                                       TCG  RT
                                       CNN  TA
                                       ITT  QQ
                                       MK   HH
                                             V
                                             M
```

TABLE 14

Individual VH sequences from converted clones

| Protein region | SEQ ID NO: | Sequence<br>12345678901234567890123456890 |
|---|---|---|
| J703M1S3 #2 VH | 478 | EVQLVQSGAEVKKPGSSVKVSCKASGGTFS WYATSWVRQAPGQGLEWMGGITPILGSPIY AQKFQGRVTITADESTSTVYMELSSLRSED TAVYYCARGVYYDHRRADYWGQGTLVTVSS |
| J703M1S3 CDR-H1 #2 VH | Residues 31-35 of SEQ ID NO.: 478 | WYATS |
| J703M1S3 CDR-H2 #2 VH | Residues 50-66 of SEQ ID NO.: 478 | GITPILGSPIYAQKFQG |
| J703M1S3 CDR-H3 #2 VH | Residues 99-109 of SEQ ID NO.: 478 | GVYYDHRRADY |
| J703M1S3 #13 VH | 479 | EVQLVQSGAEVKKPGSSVKVSCKASGGTFS WYAISWVRQAPGQGLEWMGGITPILGAANY AQKFQGRVTITADESTSTVYMELSSLRSED TAVYYCARGVYYDPKRADYWGQGTLVTVSS |
| J703M1S3 CDR-H1 #13 VH | Residues 31-35 of SEQ ID NO.: 479 | WYAIS |
| J703M1S3 CDR-H2 #13 VH | Residues 50-66 of SEQ ID NO.: 479 | GITPILGAANYAQKFQG |
| J703M1S3 CDR-H3 #13 VH | Residues 99-109 of SEQ ID NO.: 479 | GVYYDPKRADY |
| J703M1S3 #26 VH | 480 | EVQLVQSGAEVKKPGSSVKVSCKASGGTFS WYAISWVRQAPGQGLEWMGGITPILGTANY AQKFQGRVTITADESTSTVYMELSSLRSED TAVYYCARGVYYDPKRADYWGQGTLVTVSS |
| J703M1S3 CDR-H1 #26 VH | Residues 31-35 of SEQ ID NO.: 480 | WYAIS |
| J703M1S3 CDR-H2 #26 VH | Residues 50-66 of SEQ ID NO.: 480 | GITPILGTANYAQKFQG |
| J703M1S3 CDR-H3 #26 VH | Residues 99-109 of SEQ ID NO.: 480 | GVYYDPKRADY |
| J703M1S3 #30 VH | 481 | EVQLVQSGAEVKKPGSSVKVSCKASGGTFS WYAISWVRQAPGQGLEWMGGITPILGSPIY AQKFQGRVTITADESTSTVYMELSSLRSED TAVYYCARGVYYDPKRADYWGQGTLVTVSS |

TABLE 14-continued

Individual VH sequences from converted clones

| Protein region | SEQ ID NO: | Sequence 12345678901234567890123456 7890 |
|---|---|---|
| J703M1S3 #30 VH CDR-H1 | Residues 31-35 of SEQ ID NO.: 481 | WYAIS |
| J703M1S3 #30 VH CDR-H2 | Residues 50-66 of SEQ ID NO.: 481 | GITPILGSPIYAQKFQG |
| J703M1S3 #30 VH CDR-H3 | Residues 99-109 of SEQ ID NO.: 481 | GVYYDPKRADY |
| J703M1S3 #33 VH | 482 | EVQLVQSGAEVKKPGSSVKVSCKASGGTFSWYPISWVRQAPGQGLEWMGGITPILGAGIY AQKFQGRVTITADESTSTVYMELSSLRSED TAVYYCARGVYYDFKRADYWGQGTLVTVSS |
| J703M1S3 #33 VH CDR-H1 | Residues 31-35 of SEQ ID NO.: 482 | WYPIS |
| J703M1S3 #33 VH CDR-H2 | Residues 50-66 of SEQ ID NO.: 482 | GITPILGAGIYAQKFQG |
| J703M1S3 #33 VH CDR-H3 | Residues 99-109 of SEQ ID NO.: 482 | GVYYDFKRADY |
| J703M1S3 #35 VH | 483 | EVQLVQSGAEVKKPGSSVKVSCKASGGTFSWYAISWVRQAPGQGLEWMGGITPILGSATY AQKFQGRVTITADESTSTVYMELSSLRSED TAVYYCARGIYYDPKRADYWGQGTLVTVSS |
| J703M1S3 #35 VH CDR-H1 | Residues 31-35 of SEQ ID NO.: 483 | WYAIS |
| J703M1S3 #35 VH CDR-H2 | Residues 50-66 of SEQ ID NO.: 483 | GITPILGSATYAQKFQG |
| J703M1S3 #35 VH CDR-H3 | Residues 99-109 of SEQ ID NO.: 483 | GIYYDPKRADY |
| J703M1S3 #38 VH | 484 | EVQLVQSGAEVKKPGSSVKVSCKASGGTFSWYAISWVRQAPGQGLEWMGGITPILGTPIY AQKFQGRVTITADESTSTVYMELSSLRSED TAVYYCARGVYYDFKRADYWGQGTLVTVSS |
| J703M1S3 #38 VH CDR-H1 | Residues 31-35 of SEQ ID NO.: 484 | WYAIS |
| J703M1S3 #38 VH CDR-H2 | Residues 50-66 of SEQ ID NO.: 484 | GITPILGTPIYAQKFQG |
| J703M1S3 #38 VH CDR-H3 | Residues 99-109 of SEQ ID NO.: 484 | GVYYDFKRADY |
| J703M1S3 #69 VH | 485 | EVQLVQSGAEVKKPGSSVKVSCKASGGTFSWYAISWVRQAPGQGLEWMGGITPILGSPIY AQKFQGRVTITADESTSTVYMELSSLRSED TAVYYCARGIYYDPKRADYWGQGTLVTVSS |
| J703M1S3 #69 VH CDR-H1 | Residues 31-35 of SEQ ID NO.: 485 | WYAIS |
| J703M1S3 #69 VH CDR-H2 | Residues 50-66 of SEQ ID NO.: 485 | GITPILGSPIYAQKFQG |
| J703M1S3 #69 VH CDR-H3 | Residues 99-109 of SEQ ID NO.: 485 | GIYYDPKRADY |
| J703M1S3 #90 VH | 486 | EVQLVQSGAEVKKPGSSVKVSCKASGGTFSWYAISWVRQAPGQGLEWMGGITPILGSPIY AQKFQGRVTITADESTSTVYMELSSLRSED TAVYYCARGVYYDYKRADYWGQGTLVTVSS |
| J703M1S3 #90 VH CDR-H1 | Residues 31-35 of SEQ ID NO.: 486 | WYAIS |

TABLE 14-continued

Individual VH sequences from converted clones

| Protein region | SEQ ID NO: | Sequence 12345678901234567890 1234567890 |
|---|---|---|
| J703M1S3 #90 VH | Residues 50-66 of SEQ ID NO.: 486 | GITPILGSPIYAQKFQG |
| J703M1S3 #90 VH | Residues 99-109 of SEQ ID NO.: 486 | GVYYDYKRADY |

CDR-H2

CDR-H3

TABLE 15

Individual clones VL sequences

| Protein region | SEQ ID NO: | Sequence 12345678901234567890 1234567890 |
|---|---|---|
| J703M1S3 #2 VL | 487 | EIVLTQSPDFQSVTPKEKVTITCRASQSIG NTLHWYQQKPDQSPKLLIKHVSQSVSGVPS RFSGSGSGTDFTLTINSLEAEDAATYYCHQ KVSSPSPTFGQGTKVEIK |
| J703M1S3 #2 VL CDR-L1 | Residues 24-34 of SEQ ID NO.: 487 | RASQSIGNTLH |
| J703M1S3 #2 VL CDR-L2 | Residues 50-56 of SEQ ID NO.: 487 | HVSQSVS |
| J703M1S3 #2 VL CDR-L3 | Residues 89-98 of SEQ ID NO.: 487 | HQKVSSPSPT |
| J703M1S3 #13 VL | 488 | EIVLTQSPDFQSVTPKEKVTITCRASQSIG STLHWYQQKPDQSPKLLIKHASQSNSGVPS RFSGSGSGTDFTLTINSLEAEDAATYYCHQ SSSLPPPTFGQGTKVEI |
| J703M1S3 #13 VL CDR-L1 | Residues 24-34 of SEQ ID NO.: 488 | RASQSIGSTLH |
| J703M1S3 #13 VL CDR-L2 | Residues 50-56 of SEQ ID NO.: 488 | HASQSNS |
| J703M1S3 #13 VL CDR-L3 | Residues 89-98 of SEQ ID NO.: 488 | HQSSSLPPPT |
| J703M1S3 #26 VL | 489 | EIVLTQSPDFQSVTPKEKVTITCRASQSIG SRLHWYQQKPDQSPKLLIKHASQSTSGVPS RFSGSGSGTDFTLTINSLEAEDAATYYCHQ SGSSPPRTFGQGTKVEIK |
| J703M1S3 #26 VL CDR-L1 | Residues 24-34 of SEQ ID NO.: 489 | RASQSIGSRLH |
| J703M1S3 #26 VL CDR-L2 | Residues 50-56 of SEQ ID NO.: 489 | HASQSTS |
| J703M1S3 #26 VL CDR-L3 | Residues 89-98 of SEQ ID NO.: 489 | HQSGSSPPRT |
| J703M1S3 #30 VL | 490 | EIVLTQSPDFQSVTPKEKVTITCRASQRIG SSLHWYQQKPDQSPKLLIKHASQSVSGVPS RFSGSGSGTDFTLTINSLEAEDAATYYCHQ SRSSPPPTFGQGTKVEIK |
| J703M1S3 #30 VL CDR-L1 | Residues 24-34 of SEQ ID NO.: 490 | RASQRIGSSLH |
| J703M1S3 #30 VL CDR-L2 | Residues 50-56 of SEQ ID NO.: 490 | HASQSVS |
| J703M1S3 #30 VL CDR-L3 | Residues 89-98 of SEQ ID NO.: 490 | HQSRSSPPPT |

TABLE 15-continued

Individual clones VL sequences

| Protein region | | Sequence 123456789012345678901234567890 |
|---|---|---|
| J703M1S3 #33 VL | 491 | EIVLTQSPDFQSVTPKEKVTITCRASQSIG SSLHWYQQKPDQSPKLLIKHASQSTSGVPS RFSGSGSGTDFTLTINSLEAEDAATYYCHQ SSSSPPSTFGQGTKVEIK |
| J703M1S3 #33 VL | CDR-L1 Residues 24-34 of SEQ ID NO.: 491 | RASQSIGSSLH |
| J703M1S3 #33 VL | CDR-L2 Residues 50-56 of SEQ ID NO.: 491 | HASQSTS |
| J703M1S3 #33 VL | CDR-L3 Residues 89-98 of SEQ ID NO.: 491 | HQSSSSPPST |
| J703M1S3 #35 VL | 492 | EIVLTQSPDFQSVTPKEKVTITCRASQTIG SSLHWYQQKPDQSPKLLIKHASQSISGVPS RFSGSGSGTDFTLTINSLEAEDAATYYCHQ TSSLPTPTFGQGTKVEIK |
| J703M1S3 #35 VL | CDR-L1 Residues 24-34 of SEQ ID NO.: 492 | RASQTIGSSLH |
| J703M1S3 #35 VL | CDR-L2 Residues 50-56 of SEQ ID NO.: 492 | HASQSIS |
| J703M1S3 #35 VL | CDR-L3 Residues 89-98 of SEQ ID NO.: 492 | HQTSSLPTPT |
| J703M1S3 #38 VL | 493 | EIVLTQSPDFQSVTPKEKVTITCRASQTIG SSLHWYQQKPDQSPKLLIKHASQSISGVPS RFSGSGSGTDFTLTINSLEAEDAATYYCHQ SSSSPPPTFGQGTKVEIK |
| J703M1S3 #38 VL | CDR-L1 Residues 24-34 of SEQ ID NO.: 493 | RASQTIGSSLH |
| J703M1S3 #38 VL | CDR-L2 Residues 50-56 of SEQ ID NO.: 493 | HASQSIS |
| J703M1S3 #38 VL | CDR-L3 Residues 89-98 of SEQ ID NO.: 493 | HQSSSSPPPT |
| J703M1S3 #69 VL | 494 | EIVLTQSPDFQSVTPKEKVTITCRASQSIG SSLHWYQQKPDQSPKLLIKHVSQSLSGVPS RFSGSGSGTDFTLTINSLEAEDAATYYCHQ RSSSPSPTFGQGTKVEIK |
| J703M1S3 #69 VL | CDR-L1 Residues 24-34 of SEQ ID NO.: 494 | RASQSIGSSLH |
| J703M1S3 #69 VL | CDR-L2 Residues 50-56 of SEQ ID NO.: 494 | HVSQSLS |
| J703M1S3 #69 VL | CDR-L3 Residues 89-98 of SEQ ID NO.: 494 | HQRSSSPSPT |
| J703M1S3 #90 VL | 495 | EIVLTQSPDFQSVTPKEKVTITCRASQSIG SNLHWYQQKPDQSPKLLIKHASQSISGVPS RFSGSGSGTDFTLTINSLEAEDAATYYCHQ TRTSPPLTFGQGTKVEIK |
| J703M1S3 #90 VL | CDR-L1 Residues 24-34 of SEQ ID NO.: 495 | RASQSIGSNLH |
| J703M1S3 #90 VL | CDR-L2 Residues 50-56 of SEQ ID NO.: 495 | HASQSIS |
| J703M1S3 #90 VL | CDR-L3 Residues 89-98 of SEQ ID NO.: 495 | HQTRTSPPLT |

TABLE 16

AE11-5 affinity matured scFv clones converted to full length IgG

| ScFv clone name | HC plasmid | LC plasmid | Full length IgG (protein) name |
|---|---|---|---|
| J703M1S3#2 | pJP368; pHybE-hCg1,z,non-a,mut(234,235)-J703M1S3#2 | pJP369; pHybE-hCk V3-J703M1S31#2 | AE11-5 AM1 |
| J703M1S3#13 | pJP370; pHybE-hCg1,z,non-a,mut(234,235)-J703M1S3#13 | pJP371; pHybE-hCk V3-J703M1S3#13 | AE11-5 AM2 |
| J703M1S3#26 | pJP372; pHybE-hCg1,z,non-a,mut(234,235)-J703M1S3#26 | pJP373; pHybE-hCk V3-J703M1S3#26 | AE11-5 AM3 |
| J703M1S3#30 | pJP374; pHybE-hCg1,z,non-a,mut(234,235)-J703M1S3#30 | pJP375; pHybE-hCk V3-J703M1S3#30 | AE11-5 AM4 |
| J703M1S3#33 | pJP376; pHybE-hCg1,z,non-a,mut(234,235)-J703M1S3#33 | pJP377; pHybE-hCk V3-J703M1S3#33 | AE11-5 AM5 |
| J703M1S3#35 | pJP378; pHybE-hCg1,z,non-a,mut(234,235)-J703M1S3#35 | pJP379; pHybE-hCk V3-J703M1S3#35 | AE11-5 AM6 |
| J703M1S3#38 | pJP382; pHybE-hCg1,z,non-a,mut(234,235)-J703M1S3#38 | pJP383; pHybE-hCk V3-J703M1S3#38 | AE11-5 AM8 |
| J703M1S3#69 | pJP384; pHybE-hCg1,z,non-a,mut(234,235)-J703M1S3#69 | pJP385; pHybE-hCk V3-J703M1S3#69 | AE11-5 AM9 |
| J703M1S3#90 | pJP386; pHybE-hCg1,z,non-a,mut(234,235)-J703M1S3#90 | pJP387; pHybE-hCk V3-J703M1S3#90 | AE11-5 AM10 |

1.3 TNF Enzyme-Linked Immunosorbent Assay Protocol (ELISA) and Assay Result

The following protocol is used to characterize the binding of TNF antibodies to biotinylated human or cyno TNF by enzyme-linked immunosorbent assay (ELISA). An ELISA plate was coated with 50 µl per well of goat anti human IgG-Fc at 2 µg/ml, overnight at 4° C. The plate was washed 3 times with PBS/Tween. 50 µl Mab diluted to 1 µg/ml in PBS/0.1% BSA was added to appropriate wells and incubated for 1 hour at room temperature (RT). The plate was washed 3 times with PBS/Tween. 50 µl of serial diluted biotin-human TNF was added to appropriate wells and incubated for 1 hour at RT. The plate was washed 3 times with PBS/Tween. 50 µl of streptavidin-HRP diluted 1:10,000 in PBS/0.1% BSA was added to appropriate wells and incubated for 1 hour at RT. The plate was washed 3 times with PBS/Tween. 50 µl of TMB was added to appropriate wells and the reaction was allowed to proceed for 1 minute. The reaction was stopped with 50 µl/well 2N $H_2SO_4$ and the absorbance read at 450 nm. Results are shown in Table 17.

TABLE 17

| IgG Name | EC50 in hTNF ELISA (nM) | EC50 in cynoTNF ELISA (nM) |
|---|---|---|
| AE11-5-AM1 | 1.06 | 2.14 |
| AE11-5-AM2 | 522.5 | >845 |
| AE11-5-AM3 | 1.57 | 1.55 |
| AE11-5-AM4 | 18.32 | 750.3 |
| AE11-5-AM5 | 17.7 | 2.2 |
| AE11-5-AM6 | 1.37 | >720 |
| AE11-5-AM7 | 10.32 | 1.26 |
| AE11-5-AM8 | 250.2 | 58.58 |
| AE11-5-AM9 | 16.72 | 5.29 |
| AE11-5-AM10 | 0.98 | 0.28 |

1.4 TNF Neutralization Potency of TNF Antibodies by L929 Bioassay

Human TNF was prepared at Abbott Bioresearch Center (Worcester, Mass., US) and received from the Biologics Pharmacy. Mouse TNF was prepared at Abbott Bioresearch Center and received from the Biologics Pharmacy. Rat TNF was prepared at Abbott Bioresearch Center and received from the Biologics Pharmacy. Rabbit TNF was purchased from R&D Systems. Rhesus/Macaque TNF (rhTNF) was purchased from R&D Systems. Actinomycin was purchased from Sigma Aldrich and resuspended at a stock concentration of 10 mg/mL in DMSO.

Assay Media: 10% FBS (Hyclone #SH30070.03), Gibco reagents: RPMI 1640 (#21870), 2 mM L-glutamine (#25030), 50 units/mL penicillin/50 µg/mL streptomycin (#15140), 0.1 mM MEM non-essential amino acids (#11140) and $5.5 \times 10^{-5}$ M 2-mercaptoethanol (#21985-023).

L929 cells were grown to a semi-confluent density and harvested using 0.05% tryspin (Gibco #25300). The cells were washed with PBS, counted, and resuspended at 1E6 cells/mL in assay media containing 4 µg/mL actinomycin D. The cells were seeded in a 96-well plate (Costar #3599) at a volume of 50 µL and 5E4 cells/well. Wells received 50 µL of assay media, bringing the volume to 100 µL.

A test sample was prepared as follows. The test and control IgG proteins were diluted to a 4× concentration in assay media and serial 1:3 dilutions were performed. TNF species were diluted to the following concentrations in assay media: 400 pg/mL huTNF, 200 pg/mL muTNF, 600 pg/mL ratTNF, and 100 pg/mL rabTNF. Antibody sample (200 µL) was added to the TNF (200 µL) in a 1:2 dilution scheme and allowed to incubate for 0.5 hour at room temperature.

To measure huTNF neutralization potency in this assay, the antibody/TNF solution was added to the plated cells at 100 µL for a final concentration at 375 nM-0.019 nM. The final concentration of TNF was as follows: 100 pg/mL huTNF, 50 pg/mL muTNF, 150 pg/mL ratTNF, and 25 pg/mL rabTNF. The plates were incubated for 20 hours at 37° C., 5% $CO_2$. To quantitate viability, 100 µL was removed from the wells and 10 µL of WST-1 reagent (Roche cat #11644807001) was added. Plates were incubated under assay conditions for 3.5 hours, centrifuged at 500×g, and 75 µL of supernatant transferred to an ELISA plate (Costar cat #3369). The plates were read at OD 420-600 nm on a Spectromax 190 ELISA plate reader. The neutralization potency of selected TNF/IL-17 DVD-Ig binding proteins is shown in Table 18.

TABLE 18

| IgG Name | hu TNF neutralization IC50 (nM) | rhesus TNF neutralization IC50 (nM) |
|---|---|---|
| AE11-5 AM1 | 0.439 | 0.251 |
| AE11-5 AM2 | 1.241 | 0.756 |
| AE11-5 AM3 | 0.291 | 0.165 |
| AE11-5 AM4 | 0.259 | 0.109 |
| AE11-5 AM5 | 0.968 | 0.613 |
| AE11-5 AM6 | 2.029 | 0.652 |
| AE11-5 AM7 | 0.049 | 0.104 |
| AE11-5 AM8 | 1.356 | 3.040 |
| AE11-5 AM9 | 0.391 | 0.123 |
| AE11-5 AM10 | 0.678 | 0.140 |

Example 2: Affinity Maturation of a Humanized Anti-Human TNF Antibody hMAK-195

The mouse anti-human TNF antibody MAK-195 was humanized and affinity-matured to generate a panel of humanized MAK195 variants that have cross-reactivity to cyno-TNF and improved affinity and binding kinetics against both human and cyno TNF.

To improve the affinity of hMAK195 to TNF, hypermutated CDR residues were identified from other human antibody sequences in the IgBLAST database that also shared high identity to germlines VH3-53 and IGKV1-39. The corresponding hMAK195 CDR residues were then subjected to limited mutagenesis by PCR with primers having low degeneracy at these positions to create three antibody libraries in the scFv format. The first library contained mutations at residues 31, 32, 33, 35, 50, 52, 53, 54, 56 and 58 in the VH CDR1 and 2 (Kabat numbering); the second library at residues 95 to 100, 100a, 101, and 102 in VH CDR3; and the third library at residues 28, 30, 31, 32, 50, 53, 92, 93, 94, and 95 in the three VL CDRs. To further increase the identity of hMAK195 to the human germline framework sequences, a binary degeneracy at VH positions 60 (D/A), 61 (S/D), 62 (T/S), 63 (L/V), and 65 (S/G) were introduced into the first library. Also, a binary degeneracy at VL positions 24 (K/R), 33 (V/L), 54 (R/L), 55 (H/Q), 56 (T/S), 91 (H/S) and 96 (F/Y) were introduced into the third library.

These hMAK195 variants were selected against a low concentration of biotinylated TNF for improved on-rate, off-rate, or both were carried out and antibody protein sequences of affinity-modulated hMAK195 were recovered for converting back to IgG for further characterization. All three libraries were selected separately for the ability to bind human or cynomolgus monkey TNF in the presence of decreasing concentrations of biotinylated human or cynomolgus monkey TNF antigens. All mutated CDR sequences recovered from library selections were recombined into additional libraries and the recombined libraries were subjected to more stringent selection conditions before individual antibodies are identified.

Table 19 provides a list of amino acid sequences of VH and VL of the humanized MAK-195 which were subjected to the affinity maturation selection protocol Amino acid residues of individual CDRs of each VH and VL sequence are indicated in bold.

TABLE 19

List of amino acid sequences of affinity matured hMAK195 VH variants

| Clone | SEQ ID NO: | VH |
|---|---|---|
| rHC1_B8 | 496 | EVQLVESGGGLVQPGGSLRLSCAASGFTFSNYGVSWVRQAPGKGLEWVSIIRGDGSTDYASTLKSRFTISRDNSKNTLYLQMNSLRAEDTAVYYCAREWQHGPVAYWGQGTLVTVSS |
| rHC1_H12 | 497 | EVQLVESGGGLVQPGGSLRLSCAASGFTFSNYGVSWVRQAPGKGLEWVSIIRGDGSTDYADSVKSRFTISRDNSKNTLYLQMNSLRAEDTAVYYCAREWHHGPVAYWGQGTLVTVSS |
| H1 + H2_E1 | 498 | EVQLVESGGGLVQPGGSLRLSCAASGFTFSAYGVNWVRQAPGKGLEWVSIIWGDGATDYADSVKGRFTISRDNSKNTLYLQMNSLRAEDTAVYYCAREWHHGPVAYWGQGTLVTVSS |
| rHC1_A2 | 499 | EVQLVESGGGLVQPGGSLRLSCAASGFTFSNYGVNWVRQAPGKGLEWVSMISSDGFTDYASSVKSRFTISRDNSKNTLYLQMNSLRAEDTAVYYCAREWQHGPVAYWGQGTLVTVSS |
| rHC1_H6 | 500 | EVQLVESGGGLVQPGGSLRLSCAASGFTFSNYGVTWVRQAPGKGLEWVSMIAADGSTDYASSVKGRFTISRDNSKNTLYLQMNSLRAEDTAVYYCAREWQHGPVAYWGQGTLVTVSS |
| H1 + H2_D7 | 501 | EVQLVESGGGLVQPGGSLRLSCAASGFTFSNYGVTWVRQAPGKGLEWVSMIRADGSTDYASSLKSRFTISRDNSKNTLYLQMNSLRAEDTAVYYCAREWHHGPVAYWGQGTLVTVSS |
| H1 + H2_D9 | 502 | EVQLVESGGGLVQPGGSLRLSCAASGFTFSNYGVTWVRQAPGKGLEWVSMIRDDGSTDYADTVKGRFTISRDNSKNTLYLQMNSLRAEDTAVYYCAREWHHGPVAYWGQGTLVTVSS |
| rHC1_A10 | 503 | EVQLVESGGGLVQPGGSLRLSCAASGETFSHIGVSWVRQAPGKGLEWVSMISYAGSTDYASTVKGRFTISRDNSKNTLYLQMNSLRAEDTAVYYCARLLHKGPIDYWGQGTLVTVSS |
| H1 + H2_A5 | 504 | EVQLVESGGGLVQPGGSLRLSCAASGFTFSDFGVNWVRQAPGKGLEWVSMIWSDGSTDYADTVKSRFTISRDNSKNTLYLQMNSLRAEDTAVYYCAREWHHGPVAYWGQGTLVTVSS |

TABLE 19-continued

List of amino acid sequences of affinity matured hMAK195 VH variants

| Clone | SEQ ID NO: | VH |
|---|---|---|
| H1 + H2_F8 | 505 | EVQLVESGGGLVQPGGSLRLSCAASGFTFSNYGVSWVRQAPGKGLEWVSIIRADGSTDYASSLKGRFTISRDNSKNTLYLQMNSLRAEDTAVYYCAREWHHGPVAYWGQGTLVTVSS |
| rHC1_D1 | 506 | EVQLVESGGGLVQPGGSLRLSCAASGFTFSNYGVQWVRQAPGKGLEWVSMIRGDGSTDYASSLKGRFTISRDNSKNTLYLQMNSLRAEDTAVYYCARPSHHGLIDNWGQGTLVTVSS |
| rHC2_C2 | 507 | EVQLVESGGGLVQPGGSLRLSCAASGFTFSELGVNWVRQAPGKGLEWVSYISDVGSTYYASTVKGRFTISRDNSKNTLYLQMNSLRAEDTAVYYCARDWHHGRFDYWGQGTLVTVSS |
| rHC1_G4 | 508 | EVQLVESGGGLVQPGGSLRLSCAASGFTFSNYGVSWVRQAPGKGLEWVSLIRADGSTDYADSLKGRFTISRDNSKNTLYLQMNSLRAEDTAVYYCAREWHHGPVAYWGQGTLVTVSS |
| rHC1_F3 | 509 | EVQLVESGGGLVQPGGSLRLSCAASGFTFSNYGVTWVRQAPGKGLEWVSMIRADGFTDYADSVKGRFTISRDNSKNTLYLQMNSLRAEDTAVYYCARDWQHGPSVYWGQGTLVTVSS |
| rHC1_B4 | 510 | EVQLVESGGGLVQPGGSLRLSCAASGFTFSNYGVTWVRQAPGKGLEWVSIIRADGVTDYASSVKGRFTISRDNSKNTLYLQMNSLRAEDTAVYYCAREWHHGPVAYWGQGTLVTVSS |
| H1 + H2_G3 | 511 | EVQLVESGGGLVQPGGSLRLSCAASGFTFSNYGVHWVRQAPGKGLEWVSMIGADGYTDYADSLKGRFTISRDNSKNTLYLQMNSLRAEDTAVYYCAREWHHGPVAYWGQGTLVTVSS |
| rHC1_D7 | 512 | EVQLVESGGGLVQPGGSLRLSCAASGFTFSNYGVSWVRQAPGKGLEWVSMISADGSTDYASSVKGRFTISRDNSKNTLYLQMNSLRAEDTAVYYCAREWHHGPVAYWGQGTLVTVSS |
| rHC1_D5 | 513 | EVQLVESGGGLVQPGGSLRLSCAASGFTFSNYGVTWVRQAPGKGLEWVSMIRSDGFTDYADSVKGRFTISRDNSKNTLYLQMNSLRTEDTAVYYCAREWHHGPVAYWGQGTLVTVSS |
| H1 + H2_E4 | 514 | EVQLVESGGGLVQPGGSLRLSCAASGFTFSEYGVNWVRQAPGKGLEWVSIIWHDGSTAYADTVKSRFTISRDNSKNTLYLQMNSLRAEDTAVYYCAREWHHGPVAYWGQGTLVTVSS |
| rHC1_E10 | 515 | EVQLVESGGGLVQPGGSLRLSCAASGFTFSNYGVTWVRQAPGKGLEWVSLIRGDGSTDYASSVKSRFTISRDNSKNTLYLQMNSLRAEDTAVYYCAREWHHGPVAYWGQGTLVTVSS |
| H1 + H2_B6 | 516 | EVQLVESGGGLVQPGGSLRLSCAASGFTFSNFGVSWVRQAPGKGLEWVSMIWGDGSTDYADSLKGRFTISRDNSKNTLYLQMNSLRAEDTAVYYCAREWHHGPVAYWGQGTLVTVSS |
| rHC1_B7 | 517 | EVQLVESGGGLVQPGGSLRLSCAASGFTFSNYGVTWVRQAPGKGLEWVSMIRDDGSTYYASTVKGRFTISRDNSKNTLYLQMNSLRAEDTAVYYCAREWQHGPLGYWGQGTLVTVSS |
| H1 + H2_G8 | 518 | EVQLVESGGGLVQPGGSLRLSCAASGFTFSDFGVNWVRQAPGKGLEWVSMIWAGGSTAYASTVKGRFTISRDNSKNTLYLQMNSLRAEDTAVYYCAREWHHGPVAYWGQGTLVTVSS |
| rHC1_G5 | 519 | EVQLVESGGGLVQPGGSLRLSCAASGFTFSNYGVSWVRQAPGKGLEWVSLIGADGSTDYASTVKGRFTISRDNSKNTLYLQMNSLRAEDTAVYYCAREWQYGPLAYWGQGTLVTVSS |
| H1 + H2_F1 | 520 | EVQLVESGGGLVQPGGSLRLSCAASGFTFSNYGVTWVRQAPGKGLEWVSMIEGDGGTHYASSVKGRFTISRDNSKNTLYLQMNSLRAEDTAVYYCAREWHHGPVAYWGQGTLVTVSS |
| rHC19 | 521 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPAAYWGQGTLVTVSS |
| H1 + H2_A10 | 522 | EVQLVESGGGLVQPGGSLRLSCAASGFTFSNYGVNWVRQAXGKGLEWVSMISADGTTDYASSVKGRFTISRDNSKNTLYLQMNSLRAEDTAVYYCAREWHHGPVAYWGQGTLVTVSS |

TABLE 19-continued

List of amino acid sequences of affinity matured hMAK195 VH variants

| Clone | SEQ ID NO: | VH |
|---|---|---|
| rHC1_B9 | 523 | EVQLVESGGGLVQPGGSLRLSCAASGFTFSNYGVTWVRQAPGKGLEWVSIIRGDGTTDYASTVKGRFTISRDNSKNTLYLQMNSLRAEDTAVYYCAREWQHGPLGYWGQGTLVTVSS |
| H1 + H2_F7 | 524 | EVQLVESGGGLVQPGGSLRLSCAASGFTFSHYGVGWVRQAPGKGLEWVSMIWGAGSTNYADTVKSRFTISRDNSKNTLYLQMNSLRAEDTAVYYCAREWHHGPVAYWGQGTLVTVSS |
| H1 + H2_B1 | 525 | EVQLVESGGGLVQPGGSLRLSCAASGFTFSSFGVNWVRQAPGKGLEWVSMIWADGTTDYADSLKGRFTISRDNSKNTLYLQMNSLRAEDTAVYYCAREWHHGPVAYWGQGTLVTVSS |
| rHC1_H9 | 526 | EVQLVESGGGLVQPGGSLRLSCAASGFTFSNYGVTWVRQAPGKGLEWVSVIGGDGYTDYADSVKGRFTISRDNSKNTLYLQMNSLRAEDTAVYYCAREWQHGPVAYWGQGTLVTVSS |
| H1 + H2_A12 | 527 | EVQLVESGGGLVQPGGSLRLSCAASGFTFSNYGVTWVRQAPGXGLEWVSMISSDGYTDYASSVKGRFTISRDNSKNTLYLQMNSLRAEDTAVYYCAREWHHGPVAYWGQGTLVTVSS |
| rHC2_G8 | 528 | EVQLVESGGGLVQPGGSLRLSCAASGFTFSNYGVSWVRQAPGKGLEWVSMIWSDGSTHYADTVKSRFTISRDNSKNTLYLQMNSLRAEDTAVYYCAREWHHGPVAYWGQGTLVTVSS |
| rHC2_B4 | 529 | EVQLVESGGGLVQPGGSLRLSCAASGFTFSQLGVTWVRQAPGKGLEWVSTISDAGSTYYASSVKGRFTIIRINSKNTLYLQMNSLRAEDTAVYYCARDWHHGRFAYWGQGTLVTVSS |
| H1 + H2_G5 | 530 | EVQLVESGGGLVQPGGSLRLSCAASGFTFSNYGVSWVRQAPGKGLEWVSIIRGDGSTYYASSLKGRFTISRDNSKNTLYLQMNSLRAEDTAVYYCAREWHHGPVAYWGQGTLVTVSS |
| rHC1_C6 | 531 | EVQLVESGGGLVQPGGSLRLSCAASGFTFSNYGVQWVRQAPGKGLEWVSMIRDDGSTSYASTVKGRFTISRDNSKNTLYLQMNSLRAEDTAVYYCAREWHHGPVAYWGQGTLVTVSS |
| rHC1_F5 | 532 | EVQLVESGGGLVQPGGSLRLSCAASGFTFSNYGVTWVRQAPGKGLEWVSIIRGDGSTDYASSVKSRFTISRDNSKNTLYLQMNSLRAEDTAVYYCAREWQHGPVAYWGQGTLVTVSS |
| H1 + H2_B4 | 533 | EVQLVESGGGLVQPGGSLRLSCAASGFTFSAYGVNWVRQAPGKGLEWVSMISGDGSTDYADSVKSRFTISRDNSKNTLYLQMNSLRAEDTAVYYCAREWHHGPVAYWGQGTLVTVSS |
| H1 + H2_F6 | 534 | EVQLVESGGGLVQPGGSLRLSCAASGFTFSHFGVTWVRQAPGKGLEWVSNIWASGSTDYADSVKGRFTISRDNSKNTLYLQMNSLRAEDTAVYYCAREWHHGPVAYWGQGTLVTVSS |
| rHC1_B6 | 535 | EVQLVESGGGLVQPGGSLRLSCAASGFTFSNYGVTWVRQAPGKGLEWVSMIRADGSTDYADSVKGRFTISRDNSKNTLYLQMNSLRAEDTAVYYCAREWQHGPVGYWGQGTLVTVSS |
| H1 + H2_A3 | 536 | EVQLVESGGGLVQPGGSLRLSCAASGFTFSNFGVNWVRQAPGKGLEWVSVIWGDGSTAYASSVKSRFTISRDNSKNTLYLQMNSLRAEDTAVYYCAREWHHGPVAYWGQGTLVTVSS |
| rHC1_D10 | 537 | EVQLVESGGGLVQPGGSLRLSCAASGFTFSNYGVSWVRQAPGKGLEWVSIIRGDGSTDYASSVKGRFTISRDNSKNTLYLQMNSLRAEDTAVYYCAREWQHGPLAYWGQGTLVTVSS |
| rHC18 | 538 | EVQLVESGGGLVQPGGSLRLSCAASGFTFSNYGVTWVRQAPGKGLEWVSMIWSDGSTDYASSVKGRFTISRDNSKNTLYLQMNSLRAEDTAVYYCAREWQHGPVAYWGQGTLVTVSS |
| S4-18 | 539 | EVQLVESGGGLVQPGGSLRLSCAASGFTFSNYGVTWVRQAPGKGLEWVSMIWADGSTHYADSVKSRFTISRDNSKNTLYLQMNSLRAEDTAVYYCAREWQHGPLAYWGQGTLVTVSS |
| rHC2_E6 | 540 | EVQLVESGGGLVQPGGSLRLSCAASGFTFSNYGVSWVRQAPGKGLEWVSLIRGDGSTDYASSLKGRFTISRDNSKNTLYLQMNSLRAEDTAVYYCAREWHHGPVAYWGQGTLVTVSS |

TABLE 19-continued

List of amino acid sequences of affinity matured hMAK195 VH variants

| Clone | SEQ ID NO: | VH |
|---|---|---|
| H1 + H2_D4 | 541 | EVQLVESGGGLVQPGGSLRISCAASGFTFSAFGVSWVRQAPGK<br>GLEWVSMIWGDSTDYASSVKGRFTISRDNSKNTLYLQMNSLR<br>AEDTAVYYCAREWHHGPVAYWGQGTLVTVSS |
| rHC2_F8 | 542 | EVQLVESGGGLVQPGGSLRLSCAASGFTFSDLGVNWVRQAPGK<br>GLEWVSTISDIGSTYYASTVKGRFTISRDNSKNTLYLQMNSLR<br>AEDTAVYYCARDWHNGRFDYWGQGTLVTVSS |
| rHC1_F10 | 543 | EVQLVESGGGLVQPGGSLRLSCAASGFTFSNYGVSWVRQAPGK<br>GLEWVSIIRGDGFTDYADSVKGRFTISRDNSKNTLYLQMNSLR<br>AEDTAVYYCAREWHHGPVAYWGQGTLVTVSS |
| H1 + H2_C12 | 544 | EVQLVESGGGLVQPGGSLRLSCAASGFTFSNYGVTWVRQAPGK<br>GLEWVSIIRADGSTDYASSVKGRFTISRDNSKNTLYLQMNSLR<br>AEDTAVYYCAREWHHGPVAYWGQGTLVTVSS |
| H1 + H2_C11 | 545 | EVQLVESGGGLVQPGGSLRLSCAASGFTFSHFGVNWVRQAPGK<br>GLEWVSIIWGDGSTAYASSVKGRFTISRDNSKNTLYLQMNSLR<br>AEDTAVYYCAREWHHGPVAYWGQGTLVTVSS |
| rHC1_C4 | 546 | EVQLVESGGGLVQPGGSLRLSCAASGFTFSNYGVEWVRQAPGK<br>GLEWVSKIWADGSTDYADSLKSRFTISRDNSKNTLYLQMNSLR<br>AEDTAVYYCAREWQHGPLAYWGQGTLVTVSS |
| H1 + H2_E12 | 547 | EVQLVESGGGLVQPGGSLRLSCAASGFTFSDYGVNWVRQAPGK<br>GLEWVSLIWGDTTDYASSVKGRFTISRDNSKNTLYLQMNSLR<br>AEDTAVYYCAREWHHGPVAYWGQGTLVTVSS |
| H1 + H2_C4 | 548 | EVQLVESGGGLVQPGGSLRLSCAASGFTFSYFGVSWVRQAPGK<br>GLEWVSMIWGDGSTDYADSVKGRFTISRDNSKNTLYLQMNSLR<br>AEDTAVYYCAREWHHGPVAYWGQGTLVTVSS |
| rHC1_F9 | 549 | EVQLVESGGGLVQPGGSLRLSCAASGFTFSNYGVTWVRQAPGK<br>GLEWVSMIRSDGSTDYADTLKGRFTISRDNSKNTLYLQMNSLR<br>AEDTAVYYCAREWQHGPLAYWGQGTLVTVSS |
| H1 + H2_B5 | 550 | EVQLVESGGGLVQPGGSLRLSCAASGFTFSDFGVNWVRQAPGK<br>GLEWVSIIWSDGSTDYASSLKGRFTISRDNSKNTLYLQMNSLR<br>AEDTAVYYCAREWHHGPVAYWGQGTLVTVSS |
| S4-34 | 551 | EVQLVESGGGLVQPGGSLRLSCAASGFTFSNYGVSWVRQAPGK<br>GLEWVSMIWADGSTHYADTVKGRFTISRDNSKNTLYLQMNSLR<br>AEDTAVYYCAREWQHGPLAYWGQGTLVTVSS |
| H1 + H2_C2 | 552 | EVQLVESGGGLVQPGGSLRLSCAASGFTFSEFGVNWVRQAPGK<br>GLEWVSMIWGNGATDYASSVKSRFTISRDNSKNTLYLQMNSLR<br>AEDTAVYYCAREWHHGPVAYWGQGTLVTVSS |
| H1 + H2_F11 | 553 | EVQLVESGGGLVQPGGSLRLSCAASGFTFSDFGVNWVRQAPGK<br>GLEWVSMIWGDGTTAYASSVKSRFTISRDNSKNTLYLQMNSLR<br>AEDTAVYYCAREWHHGPVAYWGQGTLVTVSS |
| rHC2_E9 | 554 | EVQLVESGGGLVQPGGSLRLSCAASGFTFSNYGVTWVRQAPGK<br>GLEWVSMIRADGSTDYASSVKGRFTISRDNSKNTLYLQMNSLR<br>AEDTAVYYCAREWHHGPVAYWGQGTLVTVSS |
| H1 + H2_B2 | 555 | EVQLVESGGGLVQPGGSLRLSCAASGFTFSDFGVNWVRQAPGK<br>GLEWVSMIWGDGSTDYADSLKGRFTISRDNSKNTLYLQMNSLR<br>AEDTAVYYCAREWHHGPVAYWGQGTLVTVSS |
| H1 + H2_E9 | 556 | EVQLVESGGGLVQPGGSLRLSCAASGFTFSNFGVNWVRQAXGK<br>GLEWVSMIWGDGSTDYADSLKGRFTISRDNSKNTLYLQMNSLR<br>AEDTAVYYCAREWHHGPVAYWGQGTLVTVSS |
| rHC1_A6 | 557 | EVQLVESGGGLVQPGGSLRLSCAASGFTFSNYGVSWVRQAPGK<br>GLEWVSMIGSDGFTDYASSLKGRFTISRDNSKNTLYLQMNSLR<br>AEDTAVYYCAREWQHGPVAYWGQGTLVTVSS |
| H1 + H2_C8 | 558 | EVQLVESGGGLVQPGGSLRLSCAASGFTFSNYGVTWVRQTPGK<br>GLEWVSMIRGDGSTDYASSVKGRFTISRDNSKNTLYLQMNSLR<br>AEDTAVYYCAREWHHGPVAYWGQGTLVTVSS |

TABLE 19-continued

List of amino acid sequences of affinity matured hMAK195 VH variants

| Clone | SEQ ID NO: | VH |
|---|---|---|
| H1 + H2_C5 | 559 | EVQLVESGGGLVQPGGSLRLSCAASGFTFSDFGVSWVRQAPGK<br>GLEWVSQIWGDGSTDYADSLKGRFTISRDNSKNTLYLQMNSLR<br>AEDTAVYYCAREWHHGPVAYWGQGTLVTVSS |
| rHC2_D5 | 560 | EVQLVESGGGLVQPGGSLRLSCAASGFTFSQLGVTWVRQAPGK<br>GLEWVSTISDAGSTYYASSVKGRFTISRDNSKNTLYLQMNSLR<br>AEDTAVYYCARDWHHGRFAYWGQGTLVTVSS |
| rHC1_C7 | 561 | EVQLVESGGGLVQPGGSLRLSCAASGFTFSNYGVTWVRQAPGK<br>GLEWVSMIRADGSTDYASSVKGRFTISRDNSKNTLYLQMNSLR<br>AEDTAVYYCARDWQHGPLGYWGQGTLVTVSS |
| H1 + H2_C3 | 562 | EVQLVESGGGLVQPGGSLRLSCAASGFTFSAYGVHWVRQAPGK<br>GLEWVSMIWGDGSTDYADSVKSRFTISRDNSKNTLYLQMNSLR<br>AEDTAVYYCAREWHHGPVAYWGQGTLVTVSS |
| rHC1_G7 | 563 | EVQLVESGGGLVQPGGSLRLSCAASGFTFSNYGVTWVRQAPGK<br>GLEWVSMIRGDGTTDYASSVKGRFTISRDNSKNTLYLQMNSLR<br>AEDTAVYYCARDWQHGPIGYWGQGTLVTVSS |
| rHC1_A5 | 564 | EVQLVESGGGLVQPGGSLRLSCAASGFTFSNYGVTWVRQAPGK<br>GLEWVSMIWADGYTDYADSVKGRFTISRDNSKNTLYLQMNSLR<br>AEDTAVYYCAREWQHGPLAYWGQGTLVTVSS |
| H1 + H2_G9 | 565 | EVQLVESGGGLVQPGGSLRLSCAASGFTFSNYGVEWVRQAPGK<br>GLEWVSKIWGDGTTDYADTLKGRFTISRDNSKNTLYLQMNSLR<br>AEDTAVYYCAREWHHGPVAYWGQGTLVTVSS |
| H1 + H2_E2 | 566 | EVQLVESGGGLVQPGGSLRLSCAASGFTFSNYGVTWVRQAPGK<br>GLEWVSMIGGEGRTDYADSVKGRFTISRDNSKNTLYLQMNSLR<br>AEDTAVYYCAREWHHGPVAYWGQGTLVTVSS |
| rHC1_C9 | 567 | EVQLVESGGGLVQPGGSLRLSCAASGFTFSNLGVNWVRQAPGK<br>GLEWVSMIWDVGSTDYASSVKGRFTISRDNSKNTLYLQMNSLR<br>AEDTAVYYCARDWHHGLFDYWGQGTLVTVSS |
| rHC1_G6 | 568 | EVQLVESGGGLVQPGGSLRLSCAASGFTFSNYGVTWVRQAPGK<br>GLEWVSMIMGDGYTDYADSVKGRFTISRDNSKNTLYLQMNSLR<br>AEDTAVYYCAREWQHGPVAYWGQGTLVTVSS |
| rHC1_C1 | 569 | EVQLVESGGGLVQPGGSLRLSCAASGFTFSNYGVTWVRQAPGK<br>GLEWVSMIRDDGATDYADSVKGRFTISRDNSKNTLYLQMNSLR<br>AEDTAVYYCAREWQHGPLAYWGQGTLVTVSS |
| rHC1_C2 | 570 | EVQLVESGGGLVQPGGSLRLSCAASGFTFSNYGVTWVRQAPGK<br>GLEWVSMISGDGYTDYADSVKGRFTISRDNSKNTLYLQMNSLR<br>AEDTAVYYCAREWQHGPLAYWGQGTLVTVSS |
| H1 + H2_C1 | 571 | EVQLVESGGGLVQPGGSLRLSCAASGFTFSNYGVTWVRQAPGK<br>GLEWVSIIRGDGSTDYADSVKGRFTISRDNSKNTLYLQMNSLR<br>AEDTAVYYCAREWHHGPVAYWGQGTLVTVSS |
| H1 + H2_B10 | 572 | EVQLVESGGGLVQPGGSLRLSCAASGFTFSNFGVNWVRQAPGX<br>GLEWVSMIWADGSTDYASTLKGRFTISRDNSKNTLYLQMNSLR<br>AEDTAVYYCAREWHHGPVAYWGQGTLVTVSS |
| H1 + H2_E3 | 573 | EVQLVESGGGLVQPGGSLRLSCAASGFTFSAFGVCWVRQAPGK<br>GLEWVSMIWADGSTDYASSVKGRFTISRDNSKNTLYLQMNSLR<br>AEDTAVYYCAREWHHGPVAYWGQGTLVTVSS |
| rHC1_H4 | 574 | EVQLVESGGGLVQPGGSLRLSCAASGFTFSNYGVTWVRQAPGK<br>GLEWVSMIRSDGSTDYASSVKSRFTISRDNSKNTLYLQMNSLR<br>AEDTAVYYCARDWQHGPEGYWGQGTLVTVSS |
| rHC2_A1 | 575 | EVQLVESGGGLVQPGGSLRLSCAASGFTFSNYGVNWVRQAPGK<br>GLEWVSMIRGDGSTDYASSVKGRFTISRDNSKNTLYLQMNSLR<br>AEDTAVYYCAREWHHGPVAYWGQGTLVTVSS |
| H1 + H2_G11 | 576 | EVQLVESGGGLVQPGGSLRLSCAASGFTFSNYGVSWVRQAPGK<br>GLEWVSLIRSDGSTHYADSLKGRFTISRDNSKNTLYLQMNSLR<br>AEDTAVYYCAREWHHGPVAYWGQGTLVTVSS |

TABLE 19-continued

List of amino acid sequences of affinity matured hMAK195 VH variants

| Clone | SEQ ID NO: | VH |
|---|---|---|
| H1 + H2_D8 | 577 | EVQLVESGGGLVQPGGSLRLSCAASGFTFSNYGVNWVRQAPGKGLEWVSMIRGDGYTDYASSVKGRFTISRDNSKNTLYLQMNSLRAEDTAVYYCAREWHHGPVAYWGQGTLVTVSS |
| rHC1_A3 | 578 | EVQLVESGGGLVQPGGSLRLSCAASGFTFSNYGVTWVRQAPGKGLEWVSMIWADGSTHYADSLKGRFTISRDNSKNTLYLQMNSLRAEDTAVYYCAREWQHGPVAYWGQGTLVTVSS |
| S4-31 | 579 | EVQLVESGGGLVQPGGSLRLSCAASGFTFSNYGVQWVRQAPGKGLEWVSGIGADGSTAYASSLKGRFTISRDNSKNTLYLQMNSLRAEDTAVYYCAREWQHSGLAYWGQGTLVTVSS |
| rHC36 | 580 | EVQLVESGGGLVQPGGSLILSCAASGFTFSNYGVSWVRQAPGKGLEWVSMIWADGSTHYASSLKGRFTISRDNFKNTLYLQMNSLRAEDTAVYYCAREWQHGPVAYWGQGTLVTVSS |
| rHC2_G3 | 581 | EVQLVESGGGLVQPGGSLRLSCAASGFTFSNYGVNWVRQAPGKGLEWVSMIRGDGFTDYASSVKGRFTISRDNSKNTLYLQMNSLRAEDTAVYYCAREWHHGPVAYWGQGTLVTVSS |
| rHC1_C10 | 582 | EVQLVESGGGLVQPGGSLRLSCAASGFTFSNYGVSWVRQAPGKGLEWVSMIAADGSTAYADSLKGRFTISRDNSKNTLYLQMNSLRAEDTAVYYCAREWHHGPVAYWGQGTLVTVSS |
| rHC14 | 583 | EVQLVESGGGLVQPGGSLRLSCAASGFTFSNYGVTWVRQAPGKGLEWVSMIWADGSTHYASSLKGRFTISRDNSKNTLYLQMNSLRAEDTAVYYCAREWQHGPAAYWGQGTLVTVSS |
| rHC1_D4 | 584 | EVQLVESGGGLVQPGGSLRLSCAASGFTFSNYGVTWVRQAPGKGLEWVSMIRGDGSTDYADTVKGRFTISRDNSKNTLYLQMNSLRAEDTAVYYCAREWHHGPVAYWGQGTLVTVSS |
| rHC2_D11 | 585 | EVQLVESGGGLVQPGGSLRLSCAASGFTFSNYGVSWVRQAPGKGLEWVSIISGDGFTDYASSVKGRFTISRDNSKNTLYLQMNSLRAEDTAVYYCAREWHHGPVAYWGQGTLVTVSS |
| rHC2_E11 | 586 | EVQLVESGGGLVQPGGSLRLSCAASGFTFSDWGVHWMRQAPGKGLEWVSTIWDDGSTYYASSVKSRFTISRDNSKNTLYLQMNSLRAEDTAVYYCARHGHHGPFVYWGQGTLVTVSS |
| H1 + H2_E7 | 587 | EVQLVESGGGLVQPGGSLRLSCAASXFTFSNFGVNWVRQAPGKGLEWVSMIWGDGSTDYADSVKSRFTISRDNSKNTLYLQMNSLRAEDTAVYYCAREWHHGPVAYWGQGTLVTVSS |
| rHC1_A8 | 588 | EVQLVESGGGLVQPGGSLRLSCAASGFTFSVYGVNWVRQAPGKGLEWVSMIGDEGSTDYASTVKGRFTISRDNSKNTLYLQMNSLRAEDTAVYYCARHWHHGAVDYWGQGTLVTVSS |
| H1 + H2_B9 | 589 | EVQLVESGGGLVQPGGSLRLSCAASGFTFSDYGVNWVRQAPGKGLEWVSMIWADGSTHYADSLKSRFTISRDNSKNTLYLQMNSLRAEDTAVYYCAREWHHGPVAYWGQGTLVTVSS |
| S4-19 | 590 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| S4-74 | 591 | EVQLVESGGGLVQPGGSLRLSCAASGFTFSNYGVTWVRQAPGKGLEWVSMIWADGSTHYADTVKGRFTISRDNSKNTLYLQMNSLRAEDTAVYYCAREWQHGPLAYWGQGTLVTVSS |
| rHC1_H2 | 592 | EVQLVESGGGLVQPGGSLRLSCAASGFTFSNYGVTWVRQAPGKGLEWVSMIRGDGFTDYASSVKGRFTISRDNSKNTLYLQMNSLRAEDTAVYYCAREWQHGPVAYWGQGTLVTVSS |
| rHC1_E3 | 593 | EVQLVESGGGLVQPGGSLRLSCAASGFTFSNYGVTWVRQAPGKGLEWVSMIRADGYTSYASSVKGRFTISRDNSKNTLYLQMNSLRAEDTAVYYCAREWHHGPVAYWGQGTLVTVSS |
| rHC34 | 594 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPSAYWGQGTLVTVSS |

TABLE 19-continued

List of amino acid sequences of affinity matured hMAK195 VH variants

| Clone | SEQ ID NO: | VH |
|---|---|---|
| H1 + H2_F2 | 595 | EVQLVESGGGLVQPGGSLRLSCAASGFTFSNYGVNWVRQAPGK GLEWVSMIRADGSTDYASSVKSRFTISRDNSKNTLYLQMNSLR AEDTAVYYCAREWHHGPVAYWGQGTLVTVSS |
| rHC1_D9 | 596 | EVQLVESGGGLVQPGGSLRLSCAASGFTFSNYGVTWVRQAPGK GLEWVSMIRADGTTDYASSVKSRFTISRDNSKNTLYLQMNSLR AEDTAVYYCAREWQHGPVGYWGQGTLVTVSS |
| H1 + H2_E6 | 597 | EVQLVESGGGLVQPGGSLRLSCAASGFTFSNFGVHWVRQAPGK GLEWVSMIWADGSTVYASSVKSRFTISRDNSKNTLYLQMNSLR AEDTAVYYCAREWHHGPVAYWGQGTLVTVSS |
| H1 + H2_F3 | 598 | EVQLVESGGGLVQPGGSLRLSCAASGFTFSNYGVTWVRQAPGK GLEWVSMIGSDGSTYYADSLKSRFTISRDNSKNTLYLQMNSLR AEDTAVYYCAREWHHGPVAYWGQGTLVTVSS |
| rHC1_G11 | 599 | EVQLVESGGGLVQPGGSLRLSCAASGFTFSNYGVTWVRQAPGK GLEWVSMIRGDGFTDYASSVKGRFTISRDNSKNTLYLQMNSLR AEDTAVYYCAREWQHGPLGYWGQGTLVTVSS |
| H1 + H2_D3 | 600 | EVQLVESGGGLVQPGGSLRLSCAASGFTFSDFGVNWVRQAPGK GLEWVSMIWGDGHTAYASSVKSRFTISRDNSKNTLYLQMNSLR AEDTAVYYCAREWHHGPVAYWGQGTLVTVSS |
| H1 + H2_B12 | 601 | EVQLVESGGGLVQPGGSLRLSCAASGFTFSDYGVNWVRQAPGK GLEWVSMIWAHGATHYASSVKGRFTISRDNSKNTLYLQMNSLR AEDTAVYYCAREWHHGPVAYWGQGTLVTVSS |
| H1 + H2_B11 | 602 | EVQLVESGGGLVQPGGSLRLSCAASGFTFSNYGVTWVRQAPGK GLEWVSLIRDDGSTDYASTLKGRFTISRDNSKNTLYLQMNSLR AEDTAVYYCAREWHHGPVAYWGQGTLVTVSS |
| H1 + H2_A8 | 603 | EVQLVESGGGLVQPGGSLRLSCAASGFTFSNYGVTWVRQAPGK GLEWVSMIWGDGSTDYADSVKSRFTISRDNSKNTLYLQMNSLR AEDTAVYYCAREWHHGPVAYWGQGTLVTVSS |
| S4-24 | 604 | EVQLVESGGGLVQPGGSLRLSCAASGFTFSNYGVTWVRQAPGK GLEWVSMIWADGSTHYASSVKGRFTISRDNSKNTLYLQMNSLR AEDTAVYYCAREWQHGPVAYWGQGTLVTVSS |
| rHC1_F11 | 605 | EVQLVESGGGLVQPGGSLRLSCAASGFTFSNYGVSWVRQAPGK GLEWVSMISADGYTDYADSLKSRFTISRDNSKNTLYLQMNSLR AEDTAVYYCAREWQHGPVAYWGQGTLVTVSS |
| H1 + H2_D10 | 606 | EVQLVESGGGLVQPGGSLRLSCAASGFTFSNYGVSWVRQAPGK GLEWVSMIWADGSTHYASSLKGRFTISRDNSKNTLYLQMNSLR AEDTAVYYCAREWHHGPVAYWGQGTLVTVSS |
| rHC2_D6 | 607 | EVQLVESGGGLVQPGGSLRLSCAASGFTFSNYGVNWVRQAPGK GLEWVSMIGADGYTDYASTVKGRFTISRDNSKNTLYLQMNSLR AEDTAVYYCAREWHHGPVAYWGQGTLVTVSS |
| H1 + H2_G4 | 608 | EVQLVESGGGLVQPGGSLRLSCAASGFTFSAFGVSWVRQAPGK GLEWVSMIWADGSTDYADSVKSRFTISRDNSKNTLYLQMNSLR AEDTAVYYCAREWHHGPVAYWGQGTLVTVSS |
| H1 + H2_D11 | 609 | EVQLVESGGGLVQPGGSLRLSCAASGFTFSNYGVTWVRQAPGK GLEWVSLIRGDGSTDYASSLKGRFTISRDNSKNTLYLQMNSLR AEDTAVYYCAREWHHGPVAYWGQGTLVTVSS |
| rHC1_E9 | 610 | EVQLVESGGGLVQPGGSLRLSCAASGFTFSNYGVTWVRQAPGK GLEWVSMIWADGTTYYADSVKGRFTISRDNSKNTLYLQMNSLR AEDTAVYYCAREWQHGPLAYWGQGTLVTVSS |
| rHC1_A12 | 611 | EVQLVESGGGLVQPGGSLRLSCAASGFTFSNYGVQWVRQAPGK GLEWVSRISGDGSTDYASSVKGRFTISRDNSKNTLYLQMNSLR AEDTAVYYCAREWHHGPVAYWGQGTLVTVSS |
| H1 + H2_A2 | 612 | EVQLVESGGGLVQPGGSLRLSCAASGFSFSNFGVNWVRQAPGK GLEWVSMIWADGSTNYADTVKSRFTISRDNSKNTLYLQMNSLR AEDTAVYYCAREWHHGPVAYWGQGTLVTVSS |

TABLE 19-continued

List of amino acid sequences of affinity matured hMAK195 VH variants

| Clone | SEQ ID NO: | VH |
|---|---|---|
| H1 + H2_B7 | 613 | EVQLVESGGGLVQPGGSLRLSCAASGFTFSAYGVSWVRQAPGKGLEWVSIISADGSTDYASSVKGRFTISRDNSKNTLYLQMNSLRAEDTAVYYCAREWHHGPVAYWGQGTLVTVSS |
| rHC1_H8 | 614 | EVQLVESGGGLVQPGGSLRLSCAASGFTFSNYGVTWVRQAPGKGLEWVSMIRGDGSTDYADSLKGRFTISRDNSKNTLYLQMNSLRAEDTAVYYCAREWQHGPVAYWGQGTLVTVSS |
| rHC1_F12 | 615 | EVQLVESGGGLVQPGGSLRLSCAASGFTFSNYGVNWVRQAPGKGLEWVSMIGADGYTDYADSVKGRFTISRDNSKNTLYLQMNSLRAEDTAVYYCAREWHHGPVAYWGQGTLVTVSS |
| rHC1_E5 | 616 | EVQLVESGGGLVQPGGSLRLSCAASGFTFSNYGVTWVRQAPGKGLEWVSIIRGDGSTDYASTVKGRFTISRDNSKNTLYLQMNSLRAEDTAVYYCAREWHHGPVAYWGQGTLVTVSS |
| H1 + H2_A11 | 617 | EVQLVESGGGLVQPGGSLRLSCAASGFTFSDYGVNWVRQAPGKGLEWVSMIWGSGATDYADSVKSRFTISRDNSKNTLYLQMNSLRAEDTAVYYCAREWHHGPVAYWGQGTLVTVSS |
| rHC1_D6 | 618 | EVQLVESGGGLVQPGGSLRLSCAASGFTFSNYGVTWVRQAPGKGLEWVSMISADGFTDYADSVKGRFTISRDNSKNTLYLQMNSLRAEDTAVYYCAREWQHGPVAYWGQGTLVTVSS |
| rHC2_G10 | 619 | EVQLVESGGGLVQPGGSLRLSCAASGFTFSNYGVNWVRQAPGKGLEWVSMIAADGFTDYASSVKGRFTISRDNSKNTLYLQMNSLRAEDTAVYYCAREWHHGPVAYWGQGTLVTVSS |
| rHC1_H3 | 620 | EVQLVESGGGLVQPGGSLRLSCAASGFTFSNYGVTWVRQAPGKGLEWVSLIAADGSTDYASSVKGRFTISRDNSKNTLYLQMNSLRAEDTAVYYCAREWQHGPVAYWGQGTLVTVSS |
| H1 + H2_F10 | 621 | EVQLVESGGGLVQPGGSLRLSCAASGFTFSNYGVTWVRQAPGKGLEWVSIIRGDGSTAYADTVKGRFTISRDNSKNTLYLQMNSLRAEDTAVYYCAREWHHGPVAYWGQGTLVTVSS |
| H1 + H2_C7 | 622 | EVQLVESGGGLVQPGGSLRLSCAASGFTFSNYGVNWVRQAPGKGLEWVSMIWGDGNTGYASSVKGRFTISRDNSKNTLYLQMNSLRAEDTAVYYCAREWHHGPVAYWGQGTLVTVSS |
| rHC1_A9 | 623 | EVQLVESGGGLVQPGGSLRLSCAASGFTFSNYGVTWVRQAPGKGLEWVSMIRGDGSTDYADSVKGRFTISRDNSKNTLYLQMNSLRAEDTAVYYCAREWQHGPLAYWGQGTLVTVSS |
| H1 + H2_E5 | 624 | EVQLVESGGGLVQPGGSLRLSCAASGFTFSDYGVNWVRQAPGKGLEWVSMIWGDGSTEYADTLKGRFTISRDNSKNTLYLQMNSLRAEDTAVYYCAREWHHGPVAYWGQGTLVTVSS |
| rHC62 | 625 | EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPVGYWGQGTLVTVSS |
| H1 + H2_F4 | 626 | EVQLVESGGGLVQPGGSLRLSCAASGFTFSNYGVYWVRQAPGKGLEWVSMIWDDGSTEYADSVKSRFTISRDNSKNTLYLQMNSLRAEDTAVYYCAREWHHGPVAYWGQGTLVTVSS |
| rHC2_H8 | 627 | EVQLVESGGGLVQPGGSLRLSCAASGFTFSQLGVTWVRQAPGKGLEWVSTISDAGSTYYASSVKGRFTISRDNSKNTLYLQMNSLRAEDTAVYYCARDWHHGRFAYWGQGTLVTVSS |
| rHC2_F4 | 628 | EVQLVESGGGLVQPGGSLRLSCAASGFTFSGPGVNWVRQAPGKGLEWVSSIWDDGSTYYASSVKSRFTISRDNSKNTLYLQMNSLRAEDTAVYYCARHSHDGRFDYWGQGTLVTVSS |
| S4-50 | 629 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVGYWGQGTLVTVSS |
| H1 + H2_F12 | 630 | EVQLVESGGGLVQPGGSLRLSCAASGFTFSDYGVNWVRQAPGKGLEWVSMIWGEGSTGYASSVKGRFTISRDNSKNTLYLQMNSLRAEDTAVYYCAREWHHGPVAYWGQGTLVTVSS |

TABLE 19-continued

List of amino acid sequences of affinity matured hMAK195 VH variants

| Clone | SEQ ID NO: | VH |
|---|---|---|
| rHC1_E6 | 631 | EVQLVESGGGLVQPGGSLRLSCAASGFTFSNYGVSWVRQAPGKGLEWVSIIRDDGFTDYASSVKGRFTISRDNSKNTLYLQMNSLRAEDTAVYYCAREWHHGPVAYWGQGTLVTVSS |
| rHC1_F2 | 632 | EVQLVESGGGLVQPGGSLRLSCAASGFTFSNYGVTWVRQAPGKGLEWVSMIGGDGSTDYASSVKGRFTISRDNSKNTLYLQMNSLRAEDTAVYYCAREWQHGPVAYWGQGTLVTVSS |
| H1 + H2_G6 | 633 | EVQLVESGGGLVQPGGSLRLSCAASGFTFSDFGVNWVRQAPGKGLEWVSMIWADGTTDYDDSVKGRFTISRDNSKNTLYLQMNSLRAEDTAVYYCAREWHHGPVAYWGQGTLVTVSS |
| rHC2_F5 | 634 | EVQLVESGGGLVQPGGSLRLSCAASGFTFSNYGVNWVRQAPGKGLEWVSGISADGSTAYDSSLKGRFTISRDNSKNTLYLQMNSLRAEDTAVYYCAREWHHGPVAYWGQGTLVTVSS |
| H1 + H2_D6 | 635 | EVQLVESGGGLVQPGGSLRLSCAASGFTFSSYGVSWVRQAPGKGLEWVSLIRGDGSTYYASTVKGRFTISRDNSKNTLYLQMNSLRAEDTAVYYCAREWHHGPVAYWGQGTLVTVSS |
| H1 + H2_A9 | 636 | EVQLVESGGGLVQPGGSLRLSCAASGFTFSNFGVNWVRQAPGKGLEWVSMIWGDGSTDYASSVKSRFTISRDNSKNTLYLQMNSLRAEDTAVYYCAREWHHGPVAYWGQGTLVTVSS |
| H1 + H2_A1 | 637 | EVQLVESGGGLVQPGGSLRLSCAASGFTFSHFGVNWVRQAPGKGLEWVSMIWADGSTDYASSLKGRFTISRDNSKNTLYLQMNSLRAEDTAVYYCAREWHHGPVAYWGQGTLVTVSS |
| rHC60 | 638 | EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPAAYWGQGTLVTVSS |
| rHC1_C8 | 639 | EVQLVESGGGLVQPGGSLRLSCAASGFTFSNYGVHWVRQAPGKGLEWVSMIAGDGSTDYASSVKSRFTISRDNSKNTLYLQMNSLRAEDTAVYYCAREWQHGPVGYWGQGTLVTVSS |
| rHC44 | 640 | EVQLVESGGGLVQPGGSLRLSCAASGFTFSNYGVSWVRQAPGKGLEWVSMIWADGSTHYADTLKSRFTISRDNSKNTLYLQMNSLRAEDTAVYYCAREWQHGPVAYWGQGTLVTVSS |
| rHC1_G9 | 641 | EVQLVESGGGLVQPGGSLRLSCAASGFTFSNYGVTWVRQAPGKGLEWVSIIGADGATDYADSVKSRFTISRDNSKNTLYLQMNSLRAEDTAVYYCAREWQHGPLGYWGQGTLVTVSS |
| H1 + H2_A6 | 642 | EVQLVESGGGLVQPGGSLRLSCAASGFTFSNYGVNWVRQAPGKGLEWVSGITDGITAYASTLKSRFTISRDNSKNTLYLQMNSLRAEDTAVYYCAREWHHGPVAYWGQGTLVTVSS |
| H1 + H2_G2 | 643 | EVQLVESGGGLVQPGGSLRLSCAASGFTFSNYGVSWVRQAPGKGLEWVSMISGDGFTDYASSVKGRFTISRDNSKNTLYLQMNSLRAEDTAVYYCAREWHHGPVAYWGQGTLVTVSS |
| H1 + H2_G7 | 644 | EVQLVESGGGLVQPGGSLRLSCAASGFTFSDYGVNWVRQAPGKGLEWVSNIWGDGSTDYASSLKGRFTISRDNSKNTLYLQMNSLRAEDTAVYYCAREWHHGPVAYWGQGTLVTVSS |
| H1 + H2_E10 | 645 | EVQLVESGGGLVQPGGSLRLSCAASGFTFSNYGVNWVRQAPGKGLEWVSMIRADGSTDYADSLKGRFTISRDNSKNTLYLQMNSLRAEDTAVYYCAREWHHGPVAYWGQGTLVTVSS |
| rHC1_E2 | 646 | EVQLVESGGGLVQPGGSLRLSCAASGFTFSNYGVTWVRQAPGKGLEWVSMIRGDGSTDYADSVKGRFTISRDNSKNTLYLQMNSLRAEDTAVYYCAREWHHGPVAYWGQGTLVTVSS |
| H1 + H2_A4 | 647 | EVQLVESGGGLVQPGGSLRLSCAASGFTFSAYGVSWVRQAPGKGLEWVSMIWRDGSTDYADSLKGRFTISRDNSKNTLYLQMNSLRAEDTAVYYCAREWHHGPVAYWGQGTLVTVSS |
| H1 + H2_H3 | 648 | EVQLVESGGGLVQPGGSLRLSCAASGFTFSNYGVHWVRQAPGKGLEWVSMIWGDGSTHYASSVKSRFTISRDNSKNTLYLQMNSLRAEDTAVYYCAREWHHGPVAYWGQGTLVTVSS |

TABLE 19-continued

List of amino acid sequences of affinity matured hMAK195 VH variants

| Clone | SEQ ID NO: | VH |
|---|---|---|
| rHC1_G1 | 649 | EVQLVESGGGLVQPGGSLRLSCAASGFTFSNYGVHWVRQAPGK GLEWVSGISADGSTDYASSVKSRFTISRDNSKNTLYLQMNSLR AEDTAVYYCAREWHHGPVAYWGQGTLVTVSS |
| H1 + H2_E8 | 650 | EVQLVESGGGLVQPGGSLRLSCAASGFTFSHYGVNWVRQAPGK GLEWVSMIGGDGFTDYASSVKGRFTISRDNSKNTLYLQMNSLR AEDTAVYYCAREWHHGPVAYWGQGTLVTVSS |
| H1 + H2_C9 | 651 | EVQLVESGGGLVQPGGSLRLSCAASGFTFSNYGVNWVRQAPGK GLEWVSMIRADGSTDYASSLKSRFTISRDNSKNTLYLQMNSLR AEDTAVYYCAREWHHGPVAYWGQGTLVTVSS |
| rHC1_F7 | 652 | EVQLVESGGGLVQPGGSLRLSCAASGFTFSNYGVQWVRQAPGK GLEWVSVISADGFTDYASSVKGRFTISRDNSKNTLYLQMNSLR AEDTAVYYCAREWHHGPVAYWGQGTLVTVSS |
| rHC1_F6 | 653 | EVQLVESGGGLVQPGGSLRLSCAASGFTFSNYGVTWVRQAPGK GLEWVSMIGADGSTDYASSVKSRFTISRDNSKNTLYLQMNSLR AEDTAVYYCAREWQHGPVGYWGQGTLVTVSS |
| rHC22 | 654 | EVQLVESGGGLVQPGGSLRLSCAASGFTFSNYGVTWVRQAPGK GLEWVSMIWADGSTDYADTVKGRFTISRDNSKNTLYLQMNSLR AEDTAVYYCAREWQHGPVAYWGQGTLVTVSS |
| rHC2_G5 | 655 | EVQLVESGGGLVQPGGSLRLSCAASGFTFSNYGVSWVRQAPGK GLEWVSLIRGDGYTDYASSVKGRFTISRDNSKNTLYLQMNSLR AEDTAVYYCAREWHHGPVAYWGQGTLVTVSS |
| rHC1_C12 | 656 | EVQLVESGGGLVQPGGSLRLSCAASGFTFSHYGVSWVRQAPGK GLEWVSVIRADGVTDYASSVKGRFTISRDNSKNTLYLQMNSLR AEDTAVYYCAREWQHGPVGYWGQGTLVTVSS |
| rHC3 | 657 | EVQLVESGGGLVQPGGSLRLSCAASGFTFSNYGVSWVRQAPGK GLEWVSMIWADGSTHYASSLKGRFTISRDNSKNTLYLQMNSLR AEDTAVYYCAREWQHGPVAYWGQGTLVTVSS |
| rHC1_F1 | 658 | EVQLVESGGGLVQPGGSLRLSCAASGFTFSNYGVQWVRQAPGK GLEWVSRINGDGSTDYASTLKGRFTISRDNSKNTLYLQMNSLR AEDTAVYYCAREWHHGPVAYWGQGTLVTVSS |
| H1 + H2_E11 | 659 | EVQLVESGGGLVQPGGSLRLSCAASGFTFSNYGVNWVRQAPGK GLEWVSMIRSDGFTDYASSVKGRFTISRDNSKNTLYLQMNSLR AEDTAVYYCAREWHHGPVAYWGQGTLVTVSS |
| H1 + H2_B8 | 660 | EVQLVESGGGLVQPGGSLRLSCAASGFTFSNFGVNWVRQAPGK GLEWVSMIWVDGSTDYADSVKSRFTISRDNSKNTLYLQMNSLR AEDTAVYYCAREWHHGPVAYWGQGTLVTVSS |
| H1 + H2_G1 | 661 | EVQLVESGGGLVQPGGSLRLSCAASGFTFSDYGVNWVRQAPGK GLEWVSMIWGDGSTYYASSVKGRFTISRDNSKNTLYLQMNSLR AEDTAVYYCAREWHHGPVAYWGQGTLVTVSS |
| H1 + H2_B3 | 662 | EVQLVESGGGLVQPGGSLRLSCAASGFTFSHYGVSWVRQAPGK GLEWVSMIRSDGFTDYASTVKGRFTISRDNSKNTLYLQMNSLR AEDTAVYYCAREWHHGPVAYWGQGTLVTVSS |
| rHC1_D2 | 663 | EVQLVESGGGLVQPGGSLRLSCAASGFTFSNYGVTWVRQAPGK GLEWVSMITGDGYTDYADTVKGRFTISRDNSKNTLYLQMNSLR AEDTAVYYCAREWQHGPLAYWGQGTLVTVSS |
| rHC1_E12 | 664 | EVQLVESGGGLVQPGGSLRLSCAASGFTFSNYGVSWVRQAPGK GLEWVSIIRADGLTDYADSVKSRFTISRDNSKNTLYLQMNSLR AEDTAVYYCAREWHHGPVAYWGQGTLVTVSS |
| rHC1_B5 | 665 | EVQLVESGGGLVQPGGSLRLSCAASGFTFSNYGVSWVRQAPGK GLEWVSLIRSDGSTDYASSVKSRFTISRDNSKNTLYLQMNSLR AEDTAVYYCAREWHHGPVAYWGQGTLVTVSS |
| rHC1_D11 | 666 | EVQLVESGGGLVQPGGSLRLSCAASGFTFSNYGVTWVRQAPGK GLEWVSMIRADGSTDYADSVKGRFTISRDNSKNTLYLQMNSLR AEDTAVYYCAREWQHGPLAYWGQGTLVTVSS |

TABLE 19-continued

List of amino acid sequences of affinity matured hMAK195 VH variants

| Clone | SEQ ID NO: | VH |
|---|---|---|
| H1 + H2_A7 | 667 | EVQLVESGGGLVQPGGSLRLSCAASGFTFSDYGVIWVRQAPGKGLEWVSMIGGDGSTYYDSSLKGRFTISRDNSKNTLYLQMNSLRAEDTAVYYCAREWHHGPVAYWGQGTLVTVSS |
| rHC1_G3 | 668 | EVQLVESGGGLVQPGGSLRLSCAASGFTFSNYGVNWVRQAPGKGLEWVSMIGSDGSTDYASSVKGRFTISRDNSKNTLYLQMNSLRAEDTAVYYCAREWHHGPVAYWGQGTLVTVSS |
| H1 + H2_D5 | 669 | EVQLVESGGGLVQPGGSLRLSCAASGFTFSYYGVHWVRQAPGKGLEWVSGISGEGSTDYASSVKGRFTISRDNSKNTLYLQMNSLRAEDTAVYYCAREWHHGPVAYWGQGTLVTVSS |
| H1 + H2_D1 | 670 | EVQLVESGGGLVQPGGSLRLSCAASGFTFSNYGVTWVRQAPGKGLEWVSMIRGDGSTYYASSVKSRFTISRDNSKNTLYLQMNSLRAEDTAVYYCAREWHHGPVAYWVKGTLVTVSS |
| rHC1_E7 | 671 | EVQLVESGGGLVQPGGSLRLSCAASGFTFSNYGVSWVRQAPGKGLEWVSIIRGDGSTDYASSLKSRFTISRDNSKNTLYLQMNSLRAEDTAVYYCAREWHHGPVAYWGQGTLVTVSS |
| rHC1_E11 | 672 | EVQLVESGGGLVQPGGSLRLSCAASGFTFSNYGVTWVRQAPGKGLEWVSMIRADGTTDYASSVKGRFTISRDNSKNTLYLQMNSLRAEDTAVYYCAREWHHGPVAYWGQGTLVTVSS |
| S4-55 | 673 | EVQLVESGGGLVQPGGSLRLSCAASGFTFSNYGVTWVRQAPGKGLEWVSMIWADGSTDYASTVKGRFTISRDNSKNTLYLQMNSLRAEDTAVYYCAREWQHGPVGYWGQGTLVTVSS |
| H1 + H2_C10 | 674 | EVQLVESGGGLVQPGGSLRLSCAASGFTFSNYGVSWVRQAPGKGLEWVSMIRGDGSTYYADTLKGRFTISRDNSKNTLYLQMNSLRAEDTAVYYCAREWHHGPVAYWGQGTLVTVSS |
| H1 + H2_G10 | 675 | EVQLVESGGGLVQPGGSLRLSCAASGFTFSHFGVNWVRQAPGKGLEWVSMIWADGSTSYADSVKSRFTISRDNSKNTLYLQMNSLRAEDTAVYYCAREWHHGPVAYWGQGTLVTVSS |

Table 20 provides a list of amino acid sequences of VL regions of affinity matured fully human TNF antibodies derived from hMAK195 Amino acid residues of individual CDRs of each VH sequence are indicated in bold.

TABLE 20

List of amino acid sequences of affinity matured hMAK195 VL variants

| Clone | SEQ ID NO: | VL |
|---|---|---|
| S3_92 | 676 | DIQMTQSPSSLSASVGDRVTITCRASQKVSSAVAWYQQKPGKAPKLLIYWASTRHTGVPSRFSGSGSGTDFTLTISSLQPEDFATYYCQQHYHTPYTFGQGTKLEIK |
| S3_79 | 677 | DIQMTQSPSSLSASVGDRVTITCKASQAVSTEVAWYQQKPGKAPKLLIYCASTRQTGVPSRFSGSGSGTDFTLTISSLQPEDFATYYCQQSYSAPYTFGQGTKLEIK |
| S3_68 | 678 | DIQMTQSPSSLSASVGDRVTITCRASQVVSSAVAWYQQKPGKAPKLLIYWASKRHTGVPSRFSGSGSGTDFTLTISSLQPEDFATYYCQQHYSTPFTFGQGTKLEIK |
| S3_60 | 679 | DIQMTQSPSSLSASVGDRVTITCRASQAVSSAVAWYQQKPGKAPKLLIYWASTRHTGVPSRFSGSGSGTDFTLTISSLQPEDFATYYCQQHYSTPFTFGQGTKLEIK |
| S4-63 | 680 | DIQMTQSPSSLSASVGDRVTITCKASQKVSSALAWYQQKPGKAPKLLIYWASALHSGVPSRFSGSGSGTDFTLTISSLQPEDFATYYCQQHYRPPFTFGQGTKLEIK |
| S3_5 | 681 | DIQMTQSPSSLSASVGDRVTITCRASQGVSSAVAWYQQKPGKAPKLLIYWASTRHTGVPSRFSGSGSGTDFTLTISSLQPEDFATYYCQQHYTTPFTFGQGTKLEIK |
| S3_44 | 682 | DIQMTQSPSSLSASVGDRVTITCRASQGVSRALAWYQQKPGKAPKLLIYWASTLHSGVPSRFSGSGSGTDFTLTISSLQPEDFATYYCQQHYRAPFTFGQGTKLEIK |
| S3_53 | 683 | DIQMTQSPSSLSASVGDRVTITCRASQAVSSAVAWYQQKPGKAPKLLIYWASTRHTGVPSRFSGSGSGTDFTLTISSLQPEDFATYYCQQHYTPFTFGQGTKLEIK |
| S3_91 | 684 | DIQMTQSPSSLSASVGDRVTITCKASQGVSSALAWYQQKPGKAPKLLIYWASTRHSGVPSRFSGSGSGTDFTLTISSLQPEDFATYYCQQHYRTPFTFGQGTKLEIK |
| S3_59 | 685 | DIQMTQSPSSLSASVGDRVTITCKASQGVSSALAWYQQKPGKAPKLLIYWASTRHSGVPSRFSGSGSGTDFTLTISSLQPEDFATYYCQQHYSTPYTFGQGTKLEIK |
| S3_47 | 686 | DIQMTQSPSSLSASVGDRVTITCKASQWVSSAVAWYQQKPGKAPKLLIYWASTRQSGVPSRFSGSGSGTDFTLTISSLQPEDFATYYCQQHYRIPFTFGQGTKLEIK |

TABLE 20-continued

List of amino acid sequences of affinity matured hMAK195 VL variants

| Clone | SEQ ID NO: | VL |
|---|---|---|
| S3_70 | 687 | DIQMTQSPSSLSASVGDRVTITCKASQAVSSALAWYQQKPGKAPKLLIYWASTRHSGVPSRFSGSGSGTDFTLTISSLQPEDFATYYCQQHYSTPYTFGQGTKLEIK |
| S3_56 | 688 | DIQMTQSPSSLSASVGDRVTITCKASQRVSSAVAWYQQKPGKAPKLLIYWASTLHTGVPSRFSGSGSGTDFTLTISSLQPEDFATYYCQQHYSTPYTFGQGTKLEIK |
| S3_37 | 689 | DIQMTQSPSSLSASVGDRVTITCKASQGVSSAVAWYQQKPGKAPKLLIYWASTRHTGVPSRFSGSGSGTDFTLTISSLQPEDFATYYCQQHYNTPFTFGQGTKLEIK |
| S3_36 | 690 | DIQMTQSPSSLSASVGDRVTITCKASQKVSSAVAWYQQKPGKAPKLLIYWASARHTGVPSRFSGSGSGTDFTLTISSLQPEDFATYYCQQHYSTPFTFGQGTKLEIK |
| S3_67 | 691 | DIQMTQSPSSLSASVGDRVTITCKASQTVXRAVAWYQQKPGKAPKLLIYWASTRQSGVPSRFSGSGSGTDFTLTISSLQPEDFATYYCQQSYSTPFTFGQGTKLEIK |
| S3_40 | 692 | DIQMTQSPSSLSASVGDRVTITCRASQRVSSAVAWSQQKPGKAPKLLIYWASTRHSGVPSRFSGSGSGTDFTLTISSLQPEDFATYYCQQHYTTPYTFGQGTKLEIK |
| S3_73 | 693 | DIQMTQSPSSLSASVGDRVTITCKASQAVSSAVAWYQQKPGKAPKLLIYWASTRHSGVPSRFSGSGSGTDFTLTISSLQPEDFATYYCQQHYSTPFTFGQGTKLEIK |
| S4-50 | 694 | DIQMTQSPSSLSASVGDRVTITCKASQLVSSAVAWYQQKPGKAPKLLIYWASALHTGVPSRFSGSGSGTDFTLTISSLQPEDFATYYCQQHYSSPYTFGQGTKLEIK |
| S4-6 | 695 | DIQMTQSPSSLSASVGDRVTITCKASQLVSSAVAWYQQKPGKAPKLLIYWASTRHTGVPSRFSGSGSGTDFTLTISSLQPEDFATYYCQQHYSTPFTFGQGTKLEIK |
| S3_19 | 696 | DIQMTQSPSSLSASVGDRVTITCKASQKVSSAVAWYQQKPGKAPKLLIYWASARHSGVPSRFSGSGSGTDFTLTISSLQPEDFATYYCQQHYRSPFTFGQGTKLEIK |
| S3_83 | 697 | DIQMTQSPSSLSASVGDRVTITCRASQAVSTALAWYQQKPGKAPKLLIYSASTLQSGVPSRFSGSGSGTDFTLTISSLQPEDFATYYCQQHYRSPFTFGQGTKLEIK |
| S3_78 | 698 | DIQMTQSPSSLSASVGDRVTITCKASQYVGGAVAWYQQKPGKAPKLLIYQASTLQTGVPSRFSGSGSGTDFTLTISSLQPEDFATYYCQQHISKPFTFGQGTKLEIK |
| S4-19 | 699 | DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIK |
| S3_58 | 700 | DIQMTQSPSSLSASVGDRVTITCKASQSVNGALAWYQQKPGKAPKLLIYRASTRQTGVPSRFSGSGSGTDFTLTISSLQPEDFATYYCQQHYSIPFTFGQGTKLEIK |
| S4-31 | 701 | DIQMTQSPSSLSASVGDRVTITCKASQGVSSALAWYQQKPGKAPKLLIYWASALHSGVPSRFSGSGSGTDFTLTISSLQPEDFATYYCQQHYSAPFTFGQGTKLEIK |
| S3_31 | 702 | DIQMTQSPSSLSASVGDRVTITCKASQAVSSSVAWYQQKPGKAPKLLIYGASTLQSGVPSRFSGSGSGTDFTLTISSLQPEDFATYYCQQHYNEPYTFGQGTKLEIK |
| S3_13 | 703 | DIQMTQSPSSLSASVGDRVTITCKASQKVSSAVAWYQQKPGKAPKLLIYWASARHSGVPSRFSGSGSGTDFTLTISSLQPEDFATYYCQQHYRTPYTFGQGTKLEIK |
| S4-40 | 704 | DIQMTQSPSSLSASVGDRVTITCRASQLVSSAVAWYQQKPGKAPKLLIYWASTRHSGVPSRFSGSGSGTDFTLTISSLQPEDFATYYCQQHYRTPFSFGQGTKLEIK |
| S3_26 | 705 | DIQMTQSPSSLSASVGDRVTITCRASQAVSSAVAWYQQKPGKAPKLLIYWASKRQTGVPSRFSGSGSGTDFTLTISSLQPEDFATYYCQQHYISPYTFGQGTKLEIK |
| S3_33 | 706 | DIQMTQSPSSLSASVGDRVTITCKASQGVRSALAWYQQKPGKAPKLLIYWASTRHTGVPSRFSGSGSGTDFTLTISSLQPEDFATYYCQQSYSAPYTFGQGTKLEIK |
| S3_28 | 707 | DIQMTQSPSSLSASVGDRVTITCKASQTVSNAVAWYQQKPGKAPKLLIYWASTRHSGVPSRFSGSGSGTDFTLTISSLQPEDFATYYCQQHYSTPFTFGQGTKLEIK |
| S4-74 | 708 | DIQMTQSPSSLSASVGDRVTITCRASQLVSSAVAWYQQKPGKAPKLLIYWASARHTGVPSRFSGSGSGTDFTLTISSLQPEDFATYYCQQHYRTPFTFGQGTKLEIK |
| S3_84 | 709 | DIQMTQSPSSLSASVGDRVTITCKASQPVRSAVAWYQQKPGKAPKLLIYSASTRQTGVPSRFSGSGSGTDFTLTISSLQPEDFATYYCQQSYSIPFTFGQGTKLEIK |
| S4-54 | 710 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFSFGQGTKLEIK |
| S3_23 | 711 | DIQMTQSPSSLSASVGDRVTITCRASQAVSSAVAWYQQKPGKAPKLLIYWASSRHTGVPSRFSGSGSGTDFTLTISSLQPEDFATYYCQQHYSTPFTFGQGTKLEIK |
| S3_55 | 712 | DIQMTQSPSSLSASVGDRVTITCKASQTVGRAVAWYQQKPGKAPKLLIYWASTRQSGVPSRFSGSGSGTDFTLTISSLQPEDFATYYCQQSYSTPFTFGQGTKLEIK |
| S4-34 | 713 | DIQMTQSPSSLSASVGDRVTITCRASQLVSSAVAWYQQKPGKAPKLLIYWASTRHTGVPSRFSGSGSGTDFTLTISSLQPEDFATYYCQQHYRTPFTFGQGTKLEIK |
| S3_76 | 714 | DIQMTQSPSSLSASVGDRVTITCRASQKVSNAVAWYQQKPGKAPKLLIYWASTRHTGVPSRFSGSGSGTDFTLTISSLQPEDFATYYCQQHYNSPFTFGQGTKLEIK |
| S4-12 | 715 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIK |
| S3_86 | 716 | DIQMTQSPSSLSASVGDRVTITCRASQRVSSAVAWYQQKPGKAPKLLIYWASTRHSGVPSRFSGSGSGTDFTLTISSLQPEDFATYYCQQHYTTPYTFGQGTKLEIK |
| S3_61 | 717 | DIQMTQSPSSLSASVGDRVTITCKASQRVSSAVAWYQQKPGKAPKLLIYWASNRHSGVPSRFSGSGSGTDFTLTISSLQPEDFATYYCQQHYSTPFTFGQGTKLEIK |
| S3_18 | 718 | DIQMTQSPSSLSASVGDRVTITCKASQLVSSALAWYQQKPGKAPKLLIYWASTRQSGVPSRFSGSGSGTDFTLTISSLQPEDFATYYCQQHYRTPFTFGQGTKLEIK |
| S3_72 | 719 | DIQMTQSPSSLSASVGDRVTITCKASQLVSSALAWYQQKPGKAPKLLIYWASTRHTGVPSRFSGSGSGTDFTLTISSLQPEDFATYYCQQHYRNPFTFGQGTKLEIK |
| S3_41 | 720 | DIQMTQSPSSLSASVGDRVTITCKASQAVSSALAWYQQKPXKAPKLLIYWASSRQSGVPSRFSGSGSGTDFTLTISSLQPEDFATYYCQQHYRTPFTFGQGTKLEIK |
| S4-24 | 721 | DIQMTQSPSSLSASVGDRVTITCRASQLVSSAVAWYQQKPGKAPKLLIYWASTLHTGVPSRFSGSGSGTDFTLTISSLQPEDFATYYCQQHYRTPFTFGQGTKLEIK |
| S4-17 | 722 | DIQMTQSPSSLSASVGDRVTITCRASQLVSSAVAWYQQKPGKAPKLLIYWASTRHSGVPSRFSGSGSGTDFTLTISSLQPEDFATYYCQQHYRTPFTFGQGTKLEIK |

TABLE 20-continued

List of amino acid sequences of affinity matured hMAK195 VL variants

| Clone | SEQ ID NO: | VL |
|---|---|---|
| S3_90 | 723 | DIQMTQSPSSLSASVGDRVTITCKASQPVSGAVAWYQQKPGKAPKLLIYWASTRHTGVPSRFSGSGSGTDFTLTISSLQPEDFATYYCQQHYRASYTFGQGTKLEIK |
| S3_87 | 724 | DIQMTQSPSSLSASVGDRVTITCRASQKVSSAVAWYQQKPGKAPKLLIYWASARHTGVPSRFSGSGSGTDFTLTISSLQPEDFATYYCQQHYRTPYTFGQGTKLEIK |
| S3_66 | 725 | DIQMTQSPSSLSASVGDRVTITCRASQRVSSAVAWYQQKPGKAPKLLIYWASTRHSGVPSRFSGSGSGTDFTLTISSLQPEDFATYYCQQHYTTPYTFGQGTKLEIK |
| S4-18 | 726 | DIQMTQSPSSLSASVGDRVTITCRASQLVSSAVAWYQQKPGKAPKLLIYWASTLHSGVPSRFSGSGSGTDFTLTISSLQPEDFATYYCQQHYSTPFTFGQGTKLEIK |
| S3_4 | 727 | DIQMTQSPSSLSASVGDRVTITCRASQAVSSAVAWYQQKPGKAPKLLIYWASARHTGVPSRFSGSGSGTDFTLTISSLQPEDFATYYCQQHYSSPYTFGQGTKLEIK |
| S3_64 | 728 | DIQMTQSPSSLSASVGDRVTITCKASQPVSSAVAWYQQKPGKAPKLLIYWASTLHSGVPSRFSGSGSGTDFTLTISSLQPEDFATYYCQQHYRTPFTFGQGTKLEIK |
| S3_62 | 729 | DIQMTQSPSSLSASVGDRVTITCRASQLVSSAVAWYQQKPGKAPKLLIYWASTRHTGVPSRFSGSGSGTDFTLTISSLQPEDFATYYCQQHYRTPYTFGQGTNLEIK |
| S3_29 | 730 | DIQMTQSPSSLSASVGDIVTITCKASQLVSSAVAWYQQKPGKAPKLLIYWASTRHTGVPSRFSGSGSGTDFTLTISSLQPEDFATYYCQQHYRTPYTFGQGTKLEIK |
| S3_65 | 731 | DIQMTQSPSSLSASVGDRVTITCKASQLVSSAVAWYQQKPGKAPKLLIYWASMRHSGVPSRFSGSGSGTDFTLTISSLQPEDFATYYCQQHYSSPFTFGQGTKLEIK |
| S3_81 | 732 | DIQMTQSPSSLSASVGDRVTITCKASQTVSSAVAWYQQKPGKAPKLLIYWASTRHSGVPSRFSGSGSGTDFTLTISSLQPEDFATYYCQQHYRAPYTFGQGTKLEIK |
| S3_39 | 733 | DIQMTQSPSSLSASVGDRVTITCKASQRVSSALAWYQQKPGKAPKLLIYWASTRHTGVPSRFSGSGSGTDFTLTISSLQPEDFATYYCQQHYSTPFTFGQGTKLEIK |
| S3_49 | 734 | DIQMTQSPSSLSASVGDRVTITCRASQLVSNAVAWYQQKPGKAPKLLIYWASTRHTGVPSRFSGSGSGTDFTLTISSLQPEDFATYYCQQHYSSPFTFGQGTKLEIK |
| S3_85 | 735 | DIQMTQSPSSLSASVGDRVTITCRASQLVSSAVAWYQQKPGKAPKLLIYWASARHSGVPSRFSGSGSGTDFTLTISSLQPEDFATYYCQQHYSTPFTFGQGTKLEIK |
| S3_82 | 736 | DIQMTQSPSSLSASVGDRVTITCKASQLVSSAVAWYQQKPGKAPKLLIYWASTRHSGVPSRFSGSGSGTDFTLTISSLQPEDFATYYCQQHYTTPFTFGQGTKLEIK |
| S3_93 | 737 | DIQMTQSPSSLSASVGDRVTITCKASQRVSSAVAWYQQKPGKAPKLLIYWASTRHTGVPSRFSGSGSGTDFTLTISSLQPEDFATYYCQQHYSTPFTFGQGTKLEIK |

TABLE 21

Amino acid residues observed in affinity matured hMAK-195.

hMAK195 Heavy chain variable region (SEQ ID NO: 1075)

```
hMAK195VH EVQLVESGGGLVQPGGSLRLSCAASGFTFSDYGVNWVRQAPGKGLEWVSMIWGDGSTD
                                       NFS T                I RAG T A
                                       HLN S                V GSE F H
                                       YS  H                L SDA A V
                                       IR  Q                R AEV Y S
                                           Y                K LVG W N
                                                            S NY    G

YDSTLKSRFTISRDNSKNTLYLQMNSLRAEDTAVYYCAREWHHGPVAYWGQGTLVTSS
              ADSV G                            HSQQRTLDS
                                                QLRPASGVF
                                                LCLLVQDGC
                                                YRYNWAETN
                                                DFPYEKW  P
                                                NDARS  R I
                                                TYVTP  P H
                                                PPDDI    A
                                                AICA     I
                                                SG       C
                                                R
``` hMAK195 Light chain variable region (SEQ ID NO: 1076)

```
hMAK195VL DIQMTQSPSSLSASVGDRVTITCKASQAVSSAVAWYQQKPGKAPKLLIYWASTRHTG
                                 R  S RRPL              S SLQS
                                    V TNT               R I T
                                    G IGG               L L A
                                    D NCV               C K E
                                    T CTS               Q A F
                                    P KIR               G   R
```

TABLE 21-continued

Amino acid residues observed in affinity matured hMAK-195.

```
VPSRFSGSGSGTDFTLTISSLQPEDFATYYCQQHYSTPFTFGQGTKLEIK
                               SNRSTY
                               FGPR
                               DTML
                               GIIQ
                               HCAA
                                  S
```

The tables below provide a list of humanized MAK-195 antibodies that were converted into IgG proteins for characterization.

TABLE 22

VH sequences of IgG converted clones

| Protein region | SEQ ID NO: | Sequence |
|---|---|---|
| A8 VH | 738 | 12345678901234567890123456789 0<br>EVQLVESGGGLVQPGGSLRLSCAASGFTFS<br>NYGVNWVRQAPGKGLEWVSMIAADGFTDYA<br>SSVKGRFTISRDNSKNTLYLQMNSLRAEDT<br>AVYYCAREWHHGPVAYWGQGTLVTVSS |
| A8 VH | CDR-H1 Residues 31-35 of SEQ ID NO.: 738 | NYGVN |
| A8 VH | CDR-H2 Residues 50-65 of SEQ ID NO.: 738 | MIAADGFTDYASSVKG |
| A8 VH | CDR-H3 Residues 98-106 of SEQ ID NO.: 738 | EWHHGPVAY |
| B5 VH | 739 | EVQLVESGGGLVQPGGSLRLSCAASGFTFS<br>NYGVSWVRQAPGKGLEWVSLIRGDGSTDYA<br>SSLKGRFTISRDNSKNTLYLQMNSLRAEDT<br>AVYYCAREWHHGPVAYWGQGTLVTVSS |
| B5 VH | CDR-H1 Residues 31-35 of SEQ ID NO.: 739 | NYGVS |
| B5 VH | CDR-H2 Residues 50-65 of SEQ ID NO.: 739 | LIRGDGSTDYASSLKG |
| B5 VH | CDR-H3 Residues 98-106 of SEQ ID NO.: 739 | EWHHGPVAY |
| rHC44 VH | 740 | EVQLVESGGGLVQPGGSLRLSCAASGFTFS<br>NYGVSWVRQAPGKGLEWVSMIWADGSTHYA<br>DTLKSRFTISRDNSKNTLYLQMNSLRAEDT<br>AVYYCAREWQHGPVAYWGQGTLVTVSS |
| rHC44 VH | CDR-H1 Residues 31-35 of SEQ ID NO.: 740 | NYGVS |
| rHC44 VH | CDR-H2 Residues 50-65 of SEQ ID NO.: 740 | MIWADGSTHYADTLKS |
| rHC44 VH | CDR-H3 Residues 98-106 of SEQ ID NO.: 740 | EWQHGPVAY |
| rHC22 VH | 741 | EVQLVESGGGLVQPGGSLRLSCAASGFTFS<br>NYGVTWVRQAPGKGLEWVSMIWADGSTDYA<br>DTVKGRFTISRDNSKNTLYLQMNSLRAEDT<br>AVYYCAREWQHGPVAYWGQGTLVTVSS |
| rHC22 VH | CDR-H1 Residues 31-35 of SEQ ID NO.: 741 | NYGVT |
| rHC22 VH | CDR-H2 Residues 50-65 of SEQ ID NO.: 741 | MIWADGSTDYADTVKG |

TABLE 22-continued

VH sequences of IgG converted clones

| Protein region | SEQ ID NO: | Sequence |
| --- | --- | --- |
| rHC22 VH | CDR-H3 Residues 98-106 of SEQ ID NO.: 741 | EWQHGPVAY |
| rHC81 VH | 742 | EVQLVESGGGLVQPGGSLRLSCAASGFTFSNYGVTWVRQAPGKGLEWVSMIWADGSTHYADSVKSRFTISRDNSKNTLYLQMNSLRAEDTAVYYCAREWQHGPLAYWGQGTLVTVSS |
| rHC81 VH | CDR-H1 Residues 31-35 of SEQ ID NO.: 742 | NYGVT |
| rHC81 VH | CDR-H2 Residues 50-65 of SEQ ID NO.: 742 | MIWADGSTHYADSVKS |
| rHC81 VH | CDR-H3 Residues 98-106 of SEQ ID NO.: 742 | EWQHGPLAY |
| rHC18 VH | 743 | EVQLVESGGGLVQPGGSLRLSCAASGFTFSNYGVTWVRQAPGKGLEWVSMIWSDGSTDYASSVKGRFTISRDNSKNTLYLQMNSLRAEDTAVYYCAREWQHGPVAYWGQGTLVTVSS |
| rHC18 VH | CDR-H1 Residues 31-35 of SEQ ID NO.: 743 | NYGVT |
| rHC18 VH | CDR-H2 Residues 50-65 of SEQ ID NO.: 743 | MIWSDGSTDYASSVKG |
| rHC18 VH | CDR-H3 Residues 98-106 of SEQ ID NO.: 743 | EWQHGPVAY |
| rHC14 VH | 744 | EVQLVESGGGLVQPGGSLRLSCAASGFTFSNYGVTWVRQAPGKGLEWVSMIWADGSTHYASSLKGRFTISRDNSKNTLYLQMNSLRAEDTAVYYCAREWQHGPAAYWGQGTLVTVSS |
| rHC14 VH | CDR-H1 Residues 31-35 of SEQ ID NO.: 744 | NYGVT |
| rHC14 VH | CDR-H2 Residues 50-65 of SEQ ID NO.: 744 | MIWADGSTHYASSLKG |
| rHC14 VH | CDR-H3 Residues 98-106 of SEQ ID NO.: 744 | EWQHGPAAY |
| rHC3 VH | 745 | EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPVAYWGQGTLVTVSS |
| rHC3 VH | CDR-H1 Residues 31-35 of SEQ ID NO.: 745 | NYGVS |
| rHC3 VH | CDR-H2 Residues 50-65 of SEQ ID NO.: 745 | MIWADGSTHYASSLKG |
| rHC3 VH | CDR-H3 Residues 98-106 of SEQ ID NO.: 745 | EWQHGPVAY |
| rHC19 VH | 746 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPAAYWGQGTLVTVSS |
| rHC19 VH | CDR-H1 Residues 31-35 of SEQ ID NO.: 746 | NYGVT |
| rHC19 VH | CDR-H2 Residues 50-65 of SEQ ID NO.: 746 | MIWADGSTHYASSVKG |
| rHC19 VH | CDR-H3 Residues 98-106 of SEQ ID NO.: 746 | EWQHGPAAY |

TABLE 22-continued

VH sequences of IgG converted clones

| Protein region | SEQ ID NO: | Sequence |
|---|---|---|
| rHC34 VH | 747 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| rHC34 VH | CDR-H1 Residues 31-35 of SEQ ID NO.: 747 | NYGVT |
| rHC34 VH | CDR-H2 Residues 50-65 of SEQ ID NO.: 747 | MIWADGSTHYASSVKG |
| rHC34 VH | CDR-H3 Residues 98-106 of SEQ ID NO.: 747 | EWQHGPSAY |
| rHC83 VH | 748 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| rHC83 VH | CDR-H1 Residues 31-35 of SEQ ID NO.: 748 | NYGVT |
| rHC83 VH | CDR-H2 Residues 50-65 of SEQ ID NO.: 748 | MIWADGSTHYASSVKG |
| rHC83 VH | CDR-H3 Residues 98-106 of SEQ ID NO.: 748 | EWQHGPVAY |
| S4-19 VH | 749 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| S4-19 VH | CDR-H1 Residues 31-35 of SEQ ID NO.: 749 | NYGVE |
| S4-19 VH | CDR-H2 Residues 50-65 of SEQ ID NO.: 749 | GIWADGSTHYADTVKS |
| S4-19 VH | CDR-H3 Residues 98-106 of SEQ ID NO.: 749 | EWQHGPVAY |
| S4-50 VH | 750 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVGYWGQGTLVTVSS |
| S4-50 VH | CDR-H1 Residues 31-35 of SEQ ID NO.: 750 | NYGVE |
| S4-50 VH | CDR-H2 Residues 50-65 of SEQ ID NO.: 750 | GIWADGSTHYADTVKS |
| S4-50 VH | CDR-H3 Residues 98-106 of SEQ ID NO.: 750 | EWQHGPVGY |
| S4-63 VH | 751 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVGYWGQGTLVTVSS |
| S4-63 VH | CDR-H1 Residues 31-35 of SEQ ID NO.: 751 | NYGVE |
| S4-63 VH | CDR-H2 Residues 50-65 of SEQ ID NO.: 751 | GIWADGSTHYADTVKS |
| S4-63 VH | CDR-H3 Residues 98-106 of SEQ ID NO.: 751 | EWQHGPVGY |
| S4-55 VH | 752 | EVQLVESGGGLVQPGGSLRLSCAASGFTFSNYGVTWVRQAPGKGLEWVSMIWADGSTDYASTVKGRFTISRDNSKNTLYLQMNSLRAEDTAVYYCAREWQHGPVGYWGQGTLVTVSS |

TABLE 22-continued

VH sequences of IgG converted clones

| Protein region | SEQ ID NO: | Sequence |
|---|---|---|
| S4-55 VH CDR-H1 | Residues 31-35 of SEQ ID NO.: 752 | NYGVT |
| S4-55 VH CDR-H2 | Residues 50-65 of SEQ ID NO.: 752 | MIWADGSTDYASTVKG |
| S4-55 VH CDR-H3 | Residues 98-106 of SEQ ID NO.: 752 | EWQHGPVGY |
| S4-6 VH | 753 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-6 VH CDR-H1 | Residues 31-35 of SEQ ID NO.: 753 | NYGVT |
| S4-6 VH CDR-H2 | Residues 50-65 of SEQ ID NO.: 753 | MIWADGSTHYASSVKG |
| S4-6 VH CDR-H3 | Residues 98-106 of SEQ ID NO.: 753 | EWQHGPVAY |
| S4-18 VH | 754 | EVQLVESGGGLVQPGGSLRLSCAASGFTFSNYGVTWVRQAPGKGLEWVSMIWADGSTHYADSVKSRFTISRDNSKNTLYLQMNSLRAEDTAVYYCAREWQHGPLAYWGQGTLVTVSS |
| S4-18 VH CDR-H1 | Residues 31-35 of SEQ ID NO.: 754 | NYGVT |
| S4-18 VH CDR-H2 | Residues 50-65 of SEQ ID NO.: 754 | MIWADGSTHYADSVKS |
| S4-18 VH CDR-H3 | Residues 98-106 of SEQ ID NO.: 754 | EWQHGPLAY |
| S4-31 VH | 755 | EVQLVESGGGLVQPGGSLRLSCAASGFTFSNYGVQWVRQAPGKGLEWVSGIGADGSTAYASSLKGRFTISRDNSKNTLYLQMNSLRAEDTAVYYCAREWQHSGLAYWGQGTLVTVSS |
| S4-31 VH CDR-H1 | Residues 31-35 of SEQ ID NO.: 755 | NYGVQ |
| S4-31 VH CDR-H2 | Residues 50-65 of SEQ ID NO.: 755 | GIGADGSTAYASSLKG |
| S4-31 VH CDR-H3 | Residues 98-106 of SEQ ID NO.: 755 | EWQHSGLAY |
| S4-34 VH | 756 | EVQLVESGGGLVQPGGSLRLSCAASGFTFSNYGVSWVRQAPGKGLEWVSMIWADGSTHYADTVKGRFTISRDNSKNTLYLQMNSLRAEDTAVYYCAREWQHGPLAYWGQGTLVTVSS |
| S4-34 VH CDR-H1 | Residues 31-35 of SEQ ID NO.: 756 | NYGVS |
| S4-34 VH CDR-H2 | Residues 50-65 of SEQ ID NO.: 756 | MIWADGSTHYADTVKG |
| S4-34 VH CDR-H3 | Residues 98-106 of SEQ ID NO.: 756 | EWQHGPLAY |
| S4-74 VH | 757 | EVQLVESGGGLVQPGGSLRLSCAASGFTFSNYGVTWVRQAPGKGLEWVSMIWADGSTHYADTVKGRFTISRDNSKNTLYLQMNSLRAEDTAVYYCAREWQHGPLAYWGQGTLVTVSS |
| S4-74 VH CDR-H1 | Residues 31-35 of SEQ ID NO.: 757 | NYGVT |

TABLE 22-continued

VH sequences of IgG converted clones

| Protein region | SEQ ID NO: | Sequence |
|---|---|---|
| S4-74 VH | CDR-H2 Residues 50-65 of SEQ ID NO.: 757 | MIWADGSTHYADTVKG |
| S4-74 VH | CDR-H3 Residues 98-106 of SEQ ID NO.: 757 | EWQHGPLAY |
| S4-12 VH | 758 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-12 VH | CDR-H1 Residues 31-35 of SEQ ID NO.: 758 | NYGVT |
| S4-12 VH | CDR-H2 Residues 50-65 of SEQ ID NO.: 758 | MIWADGSTHYASSVKG |
| S4-12 VH | CDR-H3 Residues 98-106 of SEQ ID NO.: 758 | EWQHGPVAY |
| S4-54 VH | 759 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-54 VH | CDR-H1 Residues 31-35 of SEQ ID NO.: 759 | NYGVT |
| S4-54 VH | CDR-H2 Residues 50-65 of SEQ ID NO.: 759 | MIWADGSTHYASSVKG |
| S4-54 VH | CDR-H3 Residues 98-106 of SEQ ID NO.: 759 | EWQHGPVAY |
| S4-17 VH | 760 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-17 VH | CDR-H1 Residues 31-35 of SEQ ID NO.: 760 | NYGVT |
| S4-17 VH | CDR-H2 Residues 50-65 of SEQ ID NO.: 760 | MIWADGSTHYASSVKG |
| S4-17 VH | CDR-H3 Residues 98-106 of SEQ ID NO.: 760 | EWQHGPVAY |
| S4-40 VH | 761 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-40 VH | CDR-H1 Residues 31-35 of SEQ ID NO.: 761 | NYGVT |
| S4-40 VH | CDR-H2 Residues 50-65 of SEQ ID NO.: 761 | MIWADGSTHYASSVKG |
| S4-40 VH | CDR-H3 Residues 98-106 of SEQ ID NO.: 761 | EWQHGPVAY |
| S4-24 VH | 762 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-24 VH | CDR-H1 Residues 31-35 of SEQ ID NO.: 762 | NYGVT |
| S4-24 VH | CDR-H2 Residues 50-65 of SEQ ID NO.: 762 | MIWADGSTHYASSVKG |

TABLE 22-continued

VH sequences of IgG converted clones

| Protein region | SEQ ID NO: | Sequence |
| --- | --- | --- |
| S4-24 VH | CDR-H3 Residues 98-106 of SEQ ID NO.: 762 | EWQHGPVAY |

TABLE 23

VL sequences of IgG converted clones

| Protein region | SEQ ID NO: | Sequence |
| --- | --- | --- |
| hMAK195 VL.1 VL | 763 | 12345678901234567890123456 7890<br>DIQMTQSPSSLSASVGDRVTITCKASQAVS SAVAWYQQKPGKAPKLLIYWASTRHTGVPS RFSGSGSGTDFTLTISSLQPEDFATYYCQQ HYSTPFTFGQGTKLEIKR |
| hMAK195 VL.1 VL | CDR-L1 Residues 24-34 of SEQ ID NO.: 763 | KASQAVSSAVA |
| hMAK195 VL.1 VL | CDR-L2 Residues 50-56 of SEQ ID NO.: 763 | WASTRHT |
| hMAK195 VL.1 VL | CDR-L3 Residues 89-97 of SEQ ID NO.: 763 | QQHYSTPFT |
| S4-24 VL | 764 | DIQMTQSPSSLSASVGDRVTITCRASQLVS SAVAWYQQKPGKAPKLLIYWASTLHTGVPS RFSGSGSGTDFTLTISSLQPEDFATYYCQQ HYRTPFTFGQGTKLEIKR |
| S4-24 VL | CDR-L1 Residues 24-34 of SEQ ID NO.: 764 | RASQLVSSAVA |
| S4-24 VL | CDR-L2 Residues 50-56 of SEQ ID NO.: 764 | WASTLHT |
| S4-24 VL | CDR-L3 Residues 89-97 of SEQ ID NO.: 764 | QQHYRTPFT |
| S4-40 VL | 765 | DIQMTQSPSSLSASVGDRVTITCRASQLVS SAVAWYQQKPGKAPKLLIYWASTRHSGVPS RFSGSGSGTDFTLTISSLQPEDFATYYCQQ HYRTPFSFGQGTKLEIKR |
| S4-40 VL | CDR-L1 Residues 24-34 of SEQ ID NO.: 765 | RASQLVSSAVA |
| S4-40 VL | CDR-L2 Residues 50-56 of SEQ ID NO.: 765 | WASTRHS |
| S4-40 VL | CDR-L3 Residues 89-97 of SEQ ID NO.: 765 | QQHYRTPFS |
| S4-17 VL | 766 | DIQMTQSPSSLSASVGDRVTITCRASQLVS SAVAWYQQKPGKAPKLLIYWASTRHSGVPS RFSGSGSGTDFTLTISSLQPEDFATYYCQQ HYRTPFTFGQGTKLEIKR |
| S4-17 VL | CDR-L1 Residues 24-34 of SEQ ID NO.: 766 | RASQLVSSAVA |
| S4-17 VL | CDR-L2 Residues 50-56 of SEQ ID NO.: 766 | WASTRHS |
| S4-17 VL | CDR-L3 Residues 89-97 of SEQ ID NO.: 766 | QQHYRTPFT |
| S4-54 VL | 767 | DIQMTQSPSSLSASVGDRVTITCRASQLVS SAVAWYQQKPGKAPKLLIYWASARHTGVPS RFSGSGSGTDFTLTISSLQPEDFATYYCQQ HYKTPFSFGQGTKLEIKR |

TABLE 23-continued

VL sequences of IgG converted clones

| Protein region | SEQ ID NO: | Sequence |
|---|---|---|
| S4-54 VL | CDR-L1 Residues 24-34 of SEQ ID NO.: 767 | RASQLVSSAVA |
| S4-54 VL | CDR-L2 Residues 50-56 of SEQ ID NO.: 767 | WASARHT |
| S4-54 VL | CDR-L3 Residues 89-97 of SEQ ID NO.: 767 | QQHYKTPFS |
| S4-12 VL | 768 | DIQMTQSPSSLSASVGDRVTITCRASQLVS SAVAWYQQKPGKAPKLLIYWASARHTGVPS RFSGSGSGTDFTLTISSLQPEDFATYYCQQ HYKTPFTFGQGTKLEIKR |
| S4-12 VL | CDR-L1 Residues 24-34 of SEQ ID NO.: 768 | RASQLVSSAVA |
| S4-12 VL | CDR-L2 Residues 50-56 of SEQ ID NO.: 768 | WASARHT |
| S4-12 VL | CDR-L3 Residues 89-97 of SEQ ID NO.: 768 | QQHYKTPFT |
| S4-74 VL | 769 | DIQMTQSPSSLSASVGDRVTITCRASQLVS SAVAWYQQKPGKAPKLLIYWASARHTGVPS RFSGSGSGTDFTLTISSLQPEDFATYYCQQ HYRTPFTFGQGTKLEIKR |
| S4-74 VL | CDR-L1 Residues 24-34 of SEQ ID NO.: 769 | RASQLVSSAVA |
| S4-74 VL | CDR-L2 Residues 50-56 of SEQ ID NO.: 769 | WASARHT |
| S4-74 VL | CDR-L3 Residues 89-97 of SEQ ID NO.: 769 | QQHYRTPFT |
| S4-34 VL | 770 | DIQMTQSPSSLSASVGDRVTITCRASQLVS SAVAWYQQKPGKAPKLLIYWASTRHTGVPS RFSGSGSGTDFTLTISSLQPEDFATYYCQQ HYRTPFTFGQGTKLEIKR |
| S4-34 VL | CDR-L1 Residues 24-34 of SEQ ID NO.: 770 | RASQLVSSAVA |
| S4-34 VL | CDR-L2 Residues 50-56 of SEQ ID NO.: 770 | WASTRHT |
| S4-34 VL | CDR-L3 Residues 89-97 of SEQ ID NO.: 770 | QQHYRTPFT |
| S4-31 VL | 771 | DIQMTQSPSSLSASVGDRVTITCRASQGVS SALAWYQQKPGKAPKLLIYWASALHSGVPS RFSGSGSGTDFTLTISSLQPEDFATYYCQQ HYSAPFTFGQGTKLEIKR |
| S4-31 VL | CDR-L1 Residues 24-34 of SEQ ID NO.: 771 | RASQGVSSALA |
| S4-31 VL | CDR-L2 Residues 50-56 of SEQ ID NO.: 771 | WASALHS |
| S4-31 VL | CDR-L3 Residues 89-97 of SEQ ID NO.: 771 | QQHYSAPFT |
| S4-18 VL | 772 | DIQMTQSPSSLSASVGDRVTITCRASQLVS SAVAWYQQKPGKAPKLLIYWASTLHSGVPS RFSGSGSGTDFTLTISSLQPEDFATYYCQQ HYSTPFTFGQGTKLEIKR |
| S4-18 VL | CDR-L1 Residues 24-34 of SEQ ID NO.: 772 | RASQLVSSAVA |

TABLE 23-continued

VL sequences of IgG converted clones

| Protein region | SEQ ID NO: | Sequence |
|---|---|---|
| S4-18 VL | CDR-L2 Residues 50-56 of SEQ ID NO.: 772 | WASTLHS |
| S4-18 VL | CDR-L3 Residues 89-97 of SEQ ID NO.: 772 | QQHYSTPFT |
| S4-6 VL | 773 | DIQMTQSPSSLSASVGDRVTITCKASQLVS SAVAWYQQKPGKAPKLLIYWASTRHTGVPS RFSGSGSGTDFTLTISSLQPEDFATYYCQQ HYSTPFTFGQGTKLEIKR |
| S4-6 VL | CDR-L1 Residues 24-34 of SEQ ID NO.: 773 | KASQLVSSAVA |
| S4-6 VL | CDR-L2 Residues 50-56 of SEQ ID NO.: 773 | WASTRHT |
| S4-6 VL | CDR-L3 Residues 89-97 of SEQ ID NO.: 773 | QQHYSTPFT |
| S4-55 VL | 774 | DIQMTQSPSSLSASVGDRVTITCKASQLVS SAVAWYQQKPGKAPKLLIYWASTLHTGVPS RFSGSGSGTDFTLTISSLQPEDFATYYCQQ HYRTPFTFGQGTKLEIKR |
| S4-55 VL | CDR-L1 Residues 24-34 of SEQ ID NO.: 774 | KASQLVSSAVA |
| S4-55 VL | CDR-L2 Residues 50-56 of SEQ ID NO.: 774 | WASTLHT |
| S4-55 VL | CDR-L3 Residues 89-97 of SEQ ID NO.: 774 | QQHYRTPFT |
| S4-63 VL | 775 | DIQMTQSPSSLSASVGDRVTITCKASQKVS SALAWYQQKPGKAPKLLIYWASALHSGVPS RFSGSGSGTDFTLTISSLQPEDFATYYCQQ HYRPPFTFGQGTKLEIKR |
| S4-63 VL | CDR-L1 Residues 24-34 of SEQ ID NO.: 775 | KASQKVSSALA |
| S4-63 VL | CDR-L2 Residues 50-56 of SEQ ID NO.: 775 | WASALHS |
| S4-63 VL | CDR-L3 Residues 89-97 of SEQ ID NO.: 775 | QQHYRPPFT |
| S4-50 VL | 776 | DIQMTQSPSSLSASVGDRVTITCKASQLVS SAVAWYQQKPGKAPKLLIYWASALHTGVPS RFSGSGSGTDFTLTISSLQPEDFATYYCQQ HYSSPYTFGQGTKLEIKR |
| S4-50 VL | CDR-L1 Residues 24-34 of SEQ ID NO.: 776 | KASQLVSSAVA |
| S4-50 VL | CDR-L2 Residues 50-56 of SEQ ID NO.: 776 | WASALHT |
| S4-50 VL | CDR-L3 Residues 89-97 of SEQ ID NO.: 776 | QQHYSSPYT |
| S4-19 VL | 777 | DIQMTQSPSSLSASVGDRVTITCKASQLVS SAVAWYQQKPGKAPKLLIYWASTLHTGVPS RFSGSGSGTDFTLTISSLQPEDFATYYCQQ HYRTPFTFGQGTKLEIKR |
| S4-19 VL | CDR-L1 Residues 24-34 of SEQ ID NO.: 777 | KASQLVSSAVA |
| S4-19 VL | CDR-L2 Residues 50-56 of SEQ ID NO.: 777 | WASTLHT |

TABLE 23-continued

VL sequences of IgG converted clones

| Protein region | SEQ ID NO: | Sequence |
|---|---|---|
| S4-19 VL | CDR-L3 of SEQ ID NO.: 777 | Residues 89-97 QQHYRTPFT |

TABLE 24

Heavy and light chain pairs of hMAK195 affinity matured clones

| Clone name | HC | LC | Protein name |
|---|---|---|---|
| A8 | hMAK195-A8 | hMAK195 VL.1 | hMAK195-AM11 |
| B5 | hMAK195-B5 | hMAK195 VL.1 | hMAK195-AM13 |
| rHC3 | hMAK195 rHC3 | hMAK195 VL.1 | hMAK195-AM14 |
| rHC18 | hMAK195 rHC18 | hMAK195 VL.1 | hMAK195-AM15 |
| rHC19 | hMAK195 rHC19 | hMAK195 VL.1 | hMAK195-AM16 |
| rHC22 | hMAK195 rHC22 | hMAK195 VL.1 | hMAK195-AM17 |
| rHC34 | hMAK195 rHC34 | hMAK195 VL.1 | hMAK195-AM18 |
| rHC60 | hMAK195 rHC60 | hMAK195 VL.1 | hMAK195-AM19 |
| S4-6 | hMAK195 S4-6 | hMAK195 S4-6 | hMAK195-AM20 |
| S4-12 | hMAK195 S4-12 | hMAK195 S4-12 | hMAK195-AM21 |
| S4-17 | hMAK195 S4-17 | hMAK195 S4-17 | hMAK195-AM22 |
| S4-18 | hMAK195 S4-18 | hMAK195 S4-18 | hMAK195-AM23 |
| S4-19 | hMAK195 S4-19 | hMAK195 S4-19 | hMAK195-AM24 |
| S4-24 | hMAK195 S4-24 | hMAK195 S4-24 | hMAK195-AM25 |
| S4-34 | hMAK195 S4-34 | hMAK195 S4-34 | hMAK195-AM26 |

2.1 TNF Enzyme-Linked Immunosorbent Assay Result

TABLE 25

| IgG Name | EC50 in hTNFa ELISA (nM) |
|---|---|
| hMAK195-AM11 | 0.2 |
| hMAK195-AM13 | 0.2 |
| hMAK195-AM14 | 0.051 |
| hMAK195-AM15 | 0.052 |
| hMAK195-AM16 | 0.056 |
| hMAK195-AM17 | 0.056 |
| hMAK195-AM18 | 0.052 |
| hMAK195-AM19 | 0.057 |
| hMAK195-AM20 | 0.043 |
| hMAK195-AM21 | 0.042 |
| hMAK195-AM22 | 0.052 |
| hMAK195-AM23 | 0.055 |
| hMAK195-AM24 | 0.053 |
| hMAK195-AM25 | 0.052 |
| hMAK195-AM26 | 0.061 |

2.2 TNF Neutralization Potency of TNF Antibodies by L929 Bioassay

TABLE 26

| IgG Name | hu TNF neutralization IC50 (nM) | rhesus TNF neutralization IC50 (nM) |
|---|---|---|
| hMAK195-AM11 | 0.259 | >25 |
| hMAK195-AM13 | 1.218 | 4.64 |
| hMAK195-AM14 | 0.0401 | 4.61 |
| hMAK195-AM15 | 0.036 | >150 |
| hMAK195-AM16 | 0.0105 | 0.803 |
| hMAK195-AM17 | 0.0031 | >25 |
| hMAK195-AM18 | 0.0145 | 0.4412 |
| hMAK195-AM19 | 0.0126 | 1.206 |
| hMAK195-AM20 | 0.0037 | 0.596 |
| hMAK195-AM21 | 0.009 | 0.09 |
| hMAK195-AM22 | 0.00345 | 0.2705 |

TABLE 26-continued

| IgG Name | hu TNF neutralization IC50 (nM) | rhesus TNF neutralization IC50 (nM) |
|---|---|---|
| hMAK195-AM23 | 0.0468 | 2.627 |
| hMAK195-AM24 | 0.015 | 0.557 |
| hMAK195-AM25 | 0.0114 | 0.262 |
| hMAK195-AM26 | 0.0061 | 0.2495 |

Example 3: Affinity Maturation of a Humanized Anti-Human TNF Antibody hMAK-199

The mouse anti-human TNF antibody MAK-199 was humanized and affinity-matured to generate a panel of humanized MAK195 variants that have improved affinity and binding kinetics against both human and cyno TNF. Several libraries were made according to specifications below:

Three HC libraries were made after the V2I back-mutation was first introduced and confirmed that it did not impact scFv affinity to TNF.

H1+H2 (DDK) library:
Limited mutagenesis at 7 residues (T30, N31, N35, T52a, T54, E56, T58)
Germline toggle: M34I and F63L
H1+H2 (QKQ) library:
Limited mutagenesis at 7 residues (T30, N31, N35, T52a, T54, E56, T58)
Germline toggle: M34I and F63L
Germline back-mutations: D61Q, D62K, K64Q, F67V, F69M, L71T
H3 library:
Limited mutagenesis at 12 residues 95-100, 100a-100f
Germline toggle: F91Y
LC library: library
Limited mutagenesis at 11 residues 28, 30-32, 50, 53, 91-94, 96
Germline toggles: T51A, Y71F, F87Y, and T43A/V44P (these two co-evolve)
Recombed libraries:
VH libraries will be recombined with and without VL library after library diversity is reduced after at least 3 rounds of selection.

All four libraries were selected separately for the ability to bind human or cynomolgus monkey TNF in the presence of decreasing concentrations of biotinylated human or cynomolgus monkey TNF antigens. All mutated CDR sequences recovered from library selections were recombined into additional libraries and the recombined libraries were subjected to more stringent selection conditions before individual antibodies are identified.

Table 27 provides a list of amino acid sequences of VH of the hMAK-199 antibody which were subjected to the affinity maturation selection protocol Amino acid residues of individual CDRs of each VH sequence are indicated in bold.

TABLE 27

List of amino acid sequences of affinity matured hMAK199 VH variants

| Clone | SEQ ID NO: | VH |
|---|---|---|
| J644M2S1-10VH | 778 | EVQLVQSGAEVKKPGASVKVSCKASGYTFNDYGITWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-11VH | 779 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLTTVVVTDYAMDYWGQGTTVTVSS |
| J644M2S1-12VH | 780 | EVQLVQSGAEVKKPGASVKVSCKASGYTFTNYGISWVRQAPGQGLEWMGWINTYTGEPHYAQGLTGRVTMTTDTSTSTAYMELSSLRSEDTAVYFCARKFLTTVVVTDYAMDYWGQGTTVTVSS |
| J644M2S1-13VH | 781 | EVQLVQSGAEVKKPGASVKVSCKASGYTFDNYGIQWVRQAPGQGLEWMGWINTYTGAPSYAQGFTGRVTMTTDTSTSTAYMELSSLRSEDTAVYFCARKFLTTVVVTDYAMDYWGQGTTVTVSS |
| J644M2S1-14VH | 782 | EVQLVQSGAEVKKPGASVKVSCKASGYTFTDYGINWVRQAPGQGLEWMGWINTYTGKPSYAQGFTGRVTMTTDTSTSTAYMELSSLRSEDTAVYFCARKFLTTVVVTDYAMDYWGQGTTVTVSS |
| J644M2S1-15VH | 783 | EVQLVQSGAEVKKPGASVKVSCKASGYTFSNYGMNWVRQAPGQGLEWMGWINTYTGESTYAQGFTGRVTMTTDTSTSTAYMELSSLRSEDTAVYFCARKFLTTVVVTDYAMDYWGQGTTVTVSS |
| J644M2S1-16VH | 784 | EVQLVQSGAEVKKPGASVKVSCKASGYTFKNYGMTWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-17VH | 785 | EVQLVQSGAEVKKPGASVKVSCKASGYAFTDYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-18VH | 786 | EVQLVQSGAEVKKPGASVKVSCKASGYTFNNYGINWVRQAPGQGLEWMGWINTYTGEPAYAQGFTGRVTMTTDTSTSTAYMELSSLRSEDTAVYFCARKFLTTVVVTDYAMDYWGQGTTVTVSS |
| J644M2S1-1VH | 787 | EVQLVQSGAEVKKPGASVKVSCKASGYTFRNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS |
| J644M2S1-22VH | 788 | EVQLVQSGAEVKKPGASVKVSCKASGYTFTDYGINWVRQAPGQGLEWMGWINTYTGEPTYAQGFTGRVTMTTDTSTSTAYMELSSLRSEDTAVYFCARKFLTTVVVTDYAMDYWGQGTTVTVSS |
| J644M2S1-23VH | 789 | EVQLVQSGAEVKKPGASVKVSCKASGYTFKNYGIIWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-24VH | 790 | EVQLVQSGAEVKKPGASVKVSCKASGYTFSNYGINWVRQAPGQGLEWMGWINTYTGVPTYAQGFTGRVTMTTDTSTSTAYMELSSLRSEDTAVYFCARKFLTTVVVTDYAMDYWGQGTTVTVSS |
| J644M2S1-25VH | 791 | EVQLVQSGAEVKKPGASVKVSCKASGYTFNNYGINWVRQAPGQGLEWMGWINTYTGKPSYAQGFTGRVTMTTDTSTSTAYMELSSLRSEDTAVYFCARKFLTTVVVTDYAMDYWGQGTTVTVSS |
| J644M2S1-27VH | 792 | EVQLVQSGAEVKKPGASVKVSCKASGYTFKNYGINWVRQAPGQGLEWMGWINTYTGKPTYAQGLTGRVTMTTDTSTSTAYMELSSLRSEDTAVYFCARKFLTTVVVTDYAMDYWGQGTTVTVSS |

TABLE 27-continued

List of amino acid sequences of affinity matured hMAK199 VH variants

| Clone | SEQ ID NO: | VH |
|---|---|---|
| J644M2S1-28VH | 793 | EVQLVQSGAEVKKPGASVKVSCKASGYTFRNYGINWVRQ APGQGLEWMGWINTYTGKPSYAQGFTGRVTMTTDTSTST AYMELSSLRSEDTAVYFCARKFLTTVVVTDYAMDYWGQG TTVTVSS |
| J644M2S1-2VH | 794 | EVQLVQSGAEVKKPGASVKVSCKASGYTFTNYGIXWVRQ APGQGLEWMGWINTYXGKPTYAQGFTGRVTMTTDTSTST AYMELSSLRSEDTAVYFCARKFLTTVVVTDYAMDYWGQG TTVTVSS |
| J644M2S1-31VH | 795 | EVQLVQSGAEVKKPGASVKVSCKASGYTFNNYGINWVRQ APGQGLEWMGWINTYTGEPHYAQGLTGRVTMTTDTSTST AYMELSSLRSEDTAVYFCARKFLTTVVVTDYAMDYWGQG TTVTVSS |
| J644M2S1-33VH | 796 | EVQLVQSGAEVKKPGASVKVSCKASGYTFTHYGINWVRQ APGQGLEWMGWINTYTGKPTYAQGFTGRVTMTTDTSTST AYMELSSLRSEDTAVYFCARKFLTTVVVTDYAMDYWGQG TTVTVSS |
| J644M2S1-34VH | 797 | EVQLVQSGAEVKKPGASVKVSCKASGYTFTHYGINWVRQ APGQGLEWMGWINTYTGQPTYAQGLTGRVTMTTDTSTST AYMELSSLRSEDTAVYFCARKFLTTVVVTDYAMDYWGQG TTVTVSS |
| J644M2S1-35VH | 798 | EVQLVQSGAEVKKPGASVKVSCKASGYTFTNYGITWVRQ APGQGLEWMGWINTYTGKPTYAQGFTGRVTMTTDTSTST AYMELSSLRSEDTAVYFCARKFLTTVVVTDYAMDYWGQG TTVTVSS |
| J644M2S1-36VH | 799 | EVQLVQSGAEVKKPGASVKVSCKASGYTFGNYGINWVRQ APGQGLEWMGWINTYTGKPSYAQGFTGRVTMTTDTSTST AYMELSSLRSEDTAVYFCARKFLTTVVVTDYAMDYWGQG TTVTVSS |
| J644M2S1-37VH | 800 | EVQLVQSGAEVKKPGASVKVSCKASGYTFSNYGINWVRQ APGQGLEWMGWINTYTGRPTYAQGFTGRVTMTTDTSTST AYMELSSLRSEDTAVYFCARKFLTTVVVTDYAMDYWGQG TTVTVSS |
| J644M2S1-38VH | 801 | EVQLVQSGAEVKKPGASVKVSCKASGYTFKNYGINWVRQ APGQGLEWMGWINTYTGEPHYAQGFTGRVTMTTDTSTST AYIELSSLRSEDTAVYFCARKFLTTVVVTDYAMDYWGQG TTVTVSS |
| J644M2S1-3VH | 802 | EVQLVQSGAEVKKPGASVKVSCKASGYTFTNYGINWVRQ APGQGLEWMGWINTYTGEPSYAQGFTGRVTMTTDTSTST AYMELSSLRSEDTAVYFCARKFLTTVVVTDYAMDYWGQG TTVTVSS |
| J644M2S1-40VH | 803 | EVQLVQSGAEVKKPGASVKVSCKASGYTFSNYGMNWVRQ APGQGLEWMGWINTYTGEPTYAQGFTGRVTMTTDTSTST AYMELSSLRSEDTAVYFCARKFLTTVVVTDYAMDYWGQG TTVTVSS |
| J644M2S1-41VH | 804 | EVQLVQSGAEVKKPGASVKVSCKASGYTFTNYGIGWVRQ APGQGLEWMGWINTYTGKPSYAQGFTGRVTMTTDTSTST AYMELSSLRSEDTAVYFCARKFLTTVVVTDYAMDYWGQG TTVTVSS |
| J644M2S1-43VH | 805 | EVQLVQSGAEVKKPGASVKVSCKASGYTFNNYGINWVRQ APGQGLEWMGWINTYTGVPSYAQGFTGRVTMTTDTSTST AYMELSSLRSEDTAVYFCARKFLTTVVVTDYAMDYWGQG TTVTVSS |
| J644M2S1-44VH | 806 | EVQLVQSGAEVKKPGASVKVSCKASGYTFSNYGIAWVRQ APGQGLEWMGWINTYTGVPTYAQGFTGRVTMTTDTSTST AYMELSSLRSEDTAVYFCARKFLTTVVVTDYAMDYWGQG TTVTVSS |
| J644M2S1-45VH | 807 | EVQLVQSGAEVKKPGASVKVSCKASGYTFNNYGINWVRQ APGQGLEWMGWINTYTGVPHYAQGFTGRVTMTTDTSTST AYMELSSLRSEDTAVYFCARKFLTTVVVTDYAMDYWGQG TTVTVSS |

TABLE 27-continued

List of amino acid sequences of affinity matured hMAK199 VH variants

| Clone | SEQ ID NO: | VH |
|---|---|---|
| J644M2S1-46VH | 808 | EVQLVQSGAEVKKPGASVKVSCKASGYTFTNYGIXWVRQAPGQGLEWMGWINTYTGEPXYAQGFTGRVTMTTDTSTSTAYMELSSLRSEDTAVYFCARKFLTTVVVTDYAMDYWGQGTTVTVSS |
| J644M2S1-47VH | 809 | EVQLVQSGAEVKKPGASVKVSCKASGYTFNNYGINWVRQAPGQGLEWMGWINTYTGVPTYAQGLTGRVTMTTDTSTSTAYMELSSLRSEDTAVYFCARKFLTTVVVTDYAMDYWGQGTTVTVSS |
| J644M2S1-48VH | 810 | EVQLVQSGAEVKKPGASVKVSCKASGYTFTNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS |
| J644M2S1-4VH | 811 | EVQLVQSGAEVKKPGASVKVSCKASGYTFTDYGITWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-50VH | 812 | EVQLVQSGAEVKKPGASVKVSCKASGYTFTNYGINWVRQAPGQGLEWMGWINTYTGVPQYAQGFTGRVTMTTDTSTSTAYMELSSLRSEDTAVYFCARKFLTTVVVTDYAMDYWGQGTTVTVSS |
| J644M2S1-51VH | 813 | EVQLVQSGAEVKKPGASVKVSCKASGYTFQNYGINWVRQAPGQGLEWMGWINTYTGVPTYAQGLTGRVTMTTDTSTSTAYMELSSLRSEDTAVYFCARKFLTTVVVTDYAMDYWGQGTTVTVSS |
| J644M2S1-53VH | 814 | EVQLVQSGAEVKKPGASVKVSCKASGYTFTQYGINWVRQAPGQGLEWMGWINTYTGDPHYAQGFTGRVTMTTDTSTSTAYMELSSLRSEDTAVYFCARKFLTTVVVTDYAMDYWGQGTTVTVSS |
| J644M2S1-54VH | 815 | EVQLVQSGAEVKKPGASVKVSCKASGYTFSNYGINWVRQAPGQGLEWMGWINTYTGLPTYAQGFTGRVTMTTDTSTSTAYMELSSLRSEDTAVYFCARKFLTTVVVTDYAMDYWGQGTTVTVSS |
| J644M2S1-55VH | 816 | EVQLVQSGAEVKKPGASVKVSCKASGYTFTNYGMNWVRQAPGQGLEWMGWINTYNGKPMYAQGFTGRVTMTTDTSTSTAYMELSSLRSEDTAVYFCARKFLTTVVVTDYAMDYWGQGTTVTVSS |
| J644M2S1-56VH | 817 | EVQLVQSGAEVKKPGASVKVSCKASGYTFRNYGITWVRQAPGQGLEWMGWINTYTGEPAYAQGLTGRVTMTTDTSTSTAYMELSSLRSEDTAVYFCARKFLTTVVVTDYAMDYWGQGTTVTVSS |
| J644M2S1-59VH | 818 | EVQLVQSGAEVKKPGASVKVSCKASGYTFNHYGINWVRQAPGQGLEWMGWINTYTGRPTYAQGFTGRVTMTTDTSTSTAYMELSSLRSEDTAVYFCARKFLTTVVVTDYAMDYWGQGTTVTVSS |
| J644M2S1-5VH | 819 | EVQLVQSGAEVKKPGASVKVSCKASGYTFSNYGINWVRQAPGQGLEWMGWINTYTGKPTYAQGLTGRVTMTTDTSTSTAYMELSSLRSEDTAVYFCARKFLTTVVVTDYAMDYWGQGTTVTVSS |
| J644M2S1-60VH | 820 | EVQLVQSGAEVKKPGASVKVSCKASGYTFNNYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-64VH | 821 | EVQLVQSGAEVKKPGASVKVSCKASGYTFDNYGINWVRQAPGQGLEWMGWINTYTGVPTYAQGFTGRVTMTTDTSTSTAYMELSSLRSEDTAVYFCARKFLTTVVVTDYAMDYWGQGTTVTVSS |
| J644M2S1-65VH | 822 | EVQLVQSGAEVKKPGASVKVSCKASGYTFNDYGIIWVRQAPGQGLEWMGWINTYTGKPSYAQGFTGRVTMTTDTSTSTAYMELSSLRSEDTAVYFCARKFLTTVVVTDYAMDYWGQGTTVTVSS |

TABLE 27-continued

List of amino acid sequences of affinity matured hMAK199 VH variants

| Clone | SEQ ID NO: | VH |
|---|---|---|
| J644M2S1-66VH | 823 | EVQLVQSGAEVKKPGASVKVSCKASGYTFSNYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-67VH | 824 | EVQLVQSGAEVKKPGASVKVSCKASGYTFANYGMNWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-68VH | 825 | EVQLVQSGAEVKKPGASVKVSCKASGYTFNNYGINWVRQAPGQGLEWMGWINTYTGEPSYAQGLTGRVTMTTDTSTSTAYMELSSLRSEDTAVYFCARKFLTTVVVTDYAMDYWGQGTTVTVSS |
| J644M2S1-6VH | 826 | EVQLVQSGAEVKKPGASVKVSCKASGYTFTNYGINWVRQAPGQGLEWMGWINTYTGVPTYAQGLTGRVTMTTDTSTSTAYMELSSLRSEDTAVYFCARKFLTTVVVTDYAMDYWGQGTTVTVSS |
| J644M2S1-71VH | 827 | EVQLVQSGAEVKKPGASVKVSCKASGYTFDHYGMNWVRQAPGQGLEWMGWINTYTGKPTYAQGLTGRVTMTTDTSTSTAYMELSSLRSEDTAVYFCARKFLTTVVVTDYAMDYWGQGTTVTVSS |
| J644M2S1-72VH | 828 | EVQLVQSGAEVKKPGASVKVSCKASGYTFTNYGIGWVRQAPGQGLEWMGWINTYTGKPSYAQGLTGRVTMTTDTSTSTAYMELSSLRSEDTAVYFCARKFLTTVVVTDYAMDYWGQGTTVTVSS |
| J644M2S1-73VH | 829 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLTTVVVTDYAMDYWGQGTTVTVSS |
| J644M2S1-74VH | 830 | EVQLVQSGAEVKKPGASVKVSCKASGYTFNNYGMNWVRQAPGQGLEWMGWINTYTGKPTYAQGLTGRVTMTTDTSTSTAYMELSSLRSEDTAVYFCARKFLTTVVVTDYAMDYWGQGTTVTVSS |
| J644M2S1-75VH | 831 | EVQLVQSGAEVKKPGASVKVSCKASGYTFDNYGMNWVRQAPGQGLEWMGWINTYTGVPTYAQGFTGRVTMTTDTSTSTAYMELSSLRSEDTAVYFCARKFLTTVVVTDYAMDYWGQGTTVTVSS |
| J644M2S1-76VH | 832 | EVQLVQSGAEVKKPGASVKVSCKASGYTFNSYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-77VH | 833 | EVQLVQSGAEVKKPGASVKVSCKASGYTFSNYGITWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-79VH | 834 | EVQLVQSGAEVKKPGASVKVSCKASGYTFTNYGINWVRQAPGQGLEWMGWINTYNGQPTYAQGFTGRVTMTTDTSTSTAYMELSSLRSEDTAVYFCARKFLTTVVVTDYAMDYWGQGTTVTVSS |
| J644M2S1-7VH | 835 | EVQLVQSGAEVKKPGASVKVSCKASGYTFTNYGIIWVRQAPGQGLEWMGWINTYTGEPTYAQGFTGRVTMTTDTSTSTAYMELSSLRSEDTAVYFCARKFLTTVVVTDYAMDYWGQGTTVTVSS |
| J644M2S1-81VH | 836 | EVQLVQSGAEVKKPGASVKVSCKASGYTFANYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-82VH | 837 | EVQLVQSGAEVKKPGASVKVSCKASGYTFSDYGIQWVRQAPGQGLEWMGWINTYTGRPTYAQGFTGRVTMTTDTSTSTAYMELSSLRSEDTAVYFCARKFLTTVVVTDYAMDYWGQGTTVTVSS |

TABLE 27-continued

List of amino acid sequences of affinity matured hMAK199 VH variants

| Clone | SEQ ID NO: | VH |
|---|---|---|
| J644M2S1-83VH | 838 | EVQLVQSGAEVKKPGASVKVSCKASGYTFSNYGISWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-84VH | 839 | EVQLVQSGAEVKKPGASVKVSCKASGYTFTNYGIQWVRQAPGQGLEWMGWINTYTGVPTYAQGFTGRVTMTTDTSTSTAYMELSSLRSEDTAVYFCARKFLTTVVVTDYAMDYWGQGTTVTVSS |
| J644M2S1-85VH | 840 | EVQLVQSGAEVKKPGASVKVSCKASGYTFTNYGINWVRQAPGQGLEWMGWINTYTGVPTYAQGFTGRVTMTTDTSTSTAYMELSSLRSEDTAVYFCARKFLTTVVVTDYAMDYWGQGTTVTVSS |
| J644M2S1-87VH | 841 | EVQLVQSGAEVKKPGASVKVSCKASGYTFTNYGINWVRQAPGQGLEWMGWINTYSGKPTYAQGFTGRVTMTTDTSTSTAYMELSSLRSEDTAVYFCARKFLTTVVVTDYAMDYWGQGTTVTVSS |
| J644M2S1-88VH | 842 | EVQLVQSGAEVKKPGASVKVSCKASGYTFSNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS |
| J644M2S1-8VH | 843 | EVQLVQSGAEVKKPGASVKVSCKASGYTFPNYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-90VH | 844 | EVQLVQSGAEVKKPGASVKVSCKASGYTFTNYGINWVRQAPGQGLEWMGWINTYTGKTNYAQGFTGRVTMTTDTSTSTAYMELSSLRSEDTAVYFCARKFLTTVVVTDYAMDYWGQGTTVTVSS |
| J644M2S1-91VH | 845 | EVQLVQSGAEVKKPGASVKVSCKASGYTFNNYGINWVRQAPGQGLEWMGWINTYTGEPNYAQGFTGRVTMTTDTSTSTAYMELSSLRSEDTAVYFCARKFLTTVVVTDYAMDYWGQGTTVTVSS |
| J644M2S1-92VH | 846 | EVQLVQSGAEVKKPGASVKVSCKASGYTFSNYGITWVRQAPGQGLEWMGWINTYTGEPHYAQGLTGRVTMTTDTSTSTAYMELSSLRSEDTAVYFCARKFLTTVVVTDYAMDYWGQGTTVTVSS |
| J644M2S1-93VH | 847 | EVQLVQSGAEVKKPGASVKVSCKASGYTFKNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS |
| J644M2S1-94VH | 848 | EVQLVQSGAEVKKPGASVKVSCKASGYTFNNYGINWVRQAPGQGLEWMGWINTYTGIPTYAQGFTGRVTMTTDTSTSTAYMELSSLRSEDTAVYFCARKFLTTVVVTDYAMDYWGQGTTVTVSS |
| J644M2S1-95VH | 849 | EVQLVQSGAEVKKPGASVKVSCKASGYTFTDYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J644M2S1-96VH | 850 | EVQLVQSGAEVKKPGASVKVSCKASGYTFSNYGINWVRQAPGQGLEWMGWINTYSGVPTYAQGFTGRVTMTTDTSTSTAYMELSSLRSEDTAVYFCARKFLTTVVVTDYAMDYWGQGTTVTVSS |
| J644M2S1-9VH | 851 | EVQLVQSGAEVKKPGASVKVSCKASGYTFTDYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J647M2-11VH | 852 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFWRTVVGTDNAMDYWGQGTTVTVSS |

TABLE 27-continued

List of amino acid sequences of affinity matured hMAK199 VH variants

| Clone | SEQ ID NO: | VH |
|---|---|---|
| J647M2-12VH | 853 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYSTTVVVTDYAMDYWGQGTTVTVSS |
| J647M2-13VH | 854 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLTTVVVTDSAMDYWGQGTTVTVSS |
| J647M2-15VH | 855 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFMTTMAVTDFAMDYWGQGTTVTVSS |
| J647M2-16VH | 856 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLTTVVATDNAMDYWGQGTTVTVSS |
| J647M2-17VH | 857 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVIVTDNAMDYWGQGTTVTVSS |
| J647M2-19VH | 858 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFFTPVVVTDNAMDYWGQGTTVTVSS |
| J647M2-1VH | 859 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLMTTVVVTDHAMDYWGQGTTVTVSS |
| J647M2-20VH | 860 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKYLTTVVVTDSAMDYWGQGTTVTVSS |
| J647M2-21VH | 861 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFRSSVAVTDNAMDYWGQGTTVTVSS |
| J647M2-22VH | 862 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLFTTVVVTDSAMDYWGQGTTVTVSS |
| J647M2-23VH | 863 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYLMPVVVTDYAMDYWGQGTTVTVSS |
| J647M2-24VH | 864 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLDAVMVTDYAMDYWGQGTTVTVSS |
| J647M2-26VH | 865 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVVNDYAMDYWGQGTTVTVSS |
| J647M2-44VH | 866 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLTTVAVTDYAMDYWGQGTTVTVSS |
| J647M2-45VH | 867 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLKTVVATDDAMDYWGQGTTVTVSS |

TABLE 27-continued

List of amino acid sequences of affinity matured hMAK199 VH variants

| Clone | SEQ ID NO: | VH |
|---|---|---|
| J647M2-47VH | 868 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKFLNTAVVTDYAMDYWGQG TTVTVSS |
| J647M2-48VH | 869 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARRFLTTVDVTDNAMDYWGQG TTVTVSS |
| J647M2-4VH | 870 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYFCARKYLTPVVATDFAMDYWGQG TTVTVSS |
| J647M2-51VH | 871 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYFCARKCMTTIVETDNAMDYWGQG TTVTVSS |
| J647M2-52VH | 872 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKFMNTVDVTDNAMDYWGQG TTVTVSS |
| J647M2-53VH | 873 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKLFTTVVVTDDAMDYWGQG TTVTVSS |
| J647M2-54VH | 874 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKLMTTVVVTDYAMDYWGQG TTVTVSS |
| J647M2-55VH | 875 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKFLPTVVVTDYAMDYWGQG TTVTVSS |
| J647M2-56VH | 876 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYFCARKLLTTVVVTDNAMDYWGQG TTVTVSS |
| J647M2-58VH | 877 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKILTTVVVTDNAMDYWGQG TTVTVSS |
| J647M2-70VH | 878 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKVMATEVVTDYAMDYWGQG TTVTVSS |
| J647M2-71VH | 879 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKLVTTVVVTDYAMDYWGQG TTVTVSS |
| J647M2-72VH | 880 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYFCARKFRKPVSVTDYAMDYWGQG TTVTVSS |
| J647M2-73VH | 881 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKLWTTVVVTDNAMDYWGQG TTVTVSS |
| J647M2-74VH | 882 | EVQLVQSGAEVKKPGASVKVSCKASGYTFTNYGMNWVRQ APGQGLEWMGWINTYTGEPTYADDFKGRFTFTLDTSTST AYMELSSLRSEDTAVYYCARKLLTPVVVTDYAMDYWGQG TTVTVSS |

TABLE 27-continued

List of amino acid sequences of affinity matured hMAK199 VH variants

| Clone | SEQ ID NO: | VH |
|---|---|---|
| J647M2-75VH | 883 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFRTTVVETDYCMDYWGQGTTVTVSS |
| J647M2-76VH | 884 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYFTTVAVTDYAMDYWGQGTTVTVSS |
| J647M2-78VH | 885 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARRFLTTVEVTDLAMDYWGQGTTVTVSS |
| J647M2-79VH | 886 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLRTEVMTDYAMDYWGQGTTVTVSS |
| J647M2-7VH | 887 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLSTVAVTDSAMDYWGQGTTVTVSS |
| J647M2-80VH | 888 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKVLNTVVVTDYAMDYWGQGTTVTVSS |
| J647M2-83VH | 889 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFMNTAMVTDYAMDYWGQGTTVTVSS |
| J647M2-84VH | 890 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFSTTVVVTDYAMDYWGQGTTVTVSS |
| J647M2-85VH | 891 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYFTTVVVTDYAMDYWGQGTTVTVSS |
| J647M2-86VH | 892 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLNTVVVTDYAMDYWGQGTTVTVSS |
| J647M2S1-12VH | 893 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFMPTVVETDYAMDYWGQGTTVTVSS |
| J647M2S1-13VH | 894 | EVQLVQSGAEVKKPGASVKVSCKASGYTFTNYGINWVRQAPGQGLEWMGWINTYTGNPTYAQGFTGRVTMTTDTSTSTAYMELSSLRSEDTAVYFCARKFLTTVVVTDYAMDYWGQGTTVTVSS |
| J647M2S1-14VH | 895 | EVQLVQSGAEVKKPGASVKVSCKASGYTFADYGMNWVRQAPGQGLEWMGWINTYTGEPTYAQGFTGRVTMTTDTSTSTAYMELSSLRSEDTAVYFCARKFLTTVVVTDYAMDYWGQGTTVTVSS |
| J647M2S1-15VH | 896 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVVTDCAMDYWGQGTTVTVSS |
| J647M2S1-17VH | 897 | EVQLVQSGAEVKKPGASVKVSCKASGYTFTNYGMNWVRQAPGQGLEWMGWINTYTGEPTYAQGFTGRVTMTTDTSTSTAYMELSSLRSEDTAVYFCARKFLTTVVVTDYAMDYWGQGTTVTVSS |

TABLE 27-continued

List of amino acid sequences of affinity matured hMAK199 VH variants

| Clone | SEQ ID NO: | VH |
|---|---|---|
| J647M2S1-18VH | 898 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVVTDNAMDYWGQGTTVTVSS |
| J647M2S1-19VH | 899 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLNTVVGTDYAMDYWGQGTTVTVSS |
| J647M2S1-21VH | 900 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLTTEAVTDYAMDYWGQGTTVTVSS |
| J647M2S1-22VH | 901 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYSTPVVVTDYAMDYWGQGTTVTVSS |
| J647M2S1-23VH | 902 | EVQLVQSGAEVKKPGASVKVSCKASGYTFTNYGINWVRQAPGQGLEWMGWINTYTGEPTYAQGLTGRVTMTTDTSTSTAYMELSSLRSEDTAVYFCARKFLTTVVVTDYAMDYWGQGTTVTVSS |
| J647M2S1-26VH | 903 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKCLNTVAVTEHRMDYWGQGTTVTVSS |
| J647M2S1-28VH | 904 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVHTDYAMDYWGQGTTVTVSS |
| J647M2S1-30VH | 905 | EVQLVQSGAEVKKPGASVKVSCKASGYTFTNYGMNWVRQAPGQGLEWMGWINTYTGQPTYAQGFTGRVTMTTDTSTSTAYMELSSLRSEDTAVYFCARKFLTTVVVTDYAMDYWGQGTTVTVSS |
| J647M2S1-31VH | 906 | EVQLVQSGAEVKKPGASVKVSCKASGYTFTNYGINWVRQAPGQGLEWMGWINTYTGKPTYAQGFTGRVTMTTDTSTSTAYMELSSLRSEDTAVYFCARKFLTTVVVTDYAMDYWGQGTTVTVSS |
| J647M2S1-32VH | 907 | EVQLVQSGAEVKKPGASVKVSCKASGYTFANYGINWVRQAPGQGLEWMGWINTYTGEPTYAQGFTGRVTMTTDTSTSTAYMELSSLRSEDTAVYFCARKFLTTVVVTDYAMDYWGQGTTVTVSS |
| J647M2S1-33VH | 908 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFRTTVVLTDSAMDYWGQGTTVTVSS |
| J647M2S1-35VH | 909 | EVQLVQSGAEVKKPGASVKVSCKASGYTFSNYGINWVRQAPGQGLEWMGWINTYTGEPTYAQGLTGRVTMTTDTSTSTAYMELSSLRSEDTAVYFCARKFLTTVVVTDYAMDYWGQGTTVTVSS |
| J647M2S1-36VH | 910 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFQTPVVDTDYAMDYWGQGTTVTVSS |
| J647M2S1-39VH | 911 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFMKTRVVTDNAMDYWGQGTTVTVSS |
| J647M2S1-40VH | 912 | EVQLVQSGAEVKKPGASVKVSCKASGYTFSNYGIVWVRQAPGQGLEWMGWINTYTGEPTYAQGFTGRVTMTTDTSTSTAYMELSSLRSEDTAVYFCARKFLTTVVVTDYAMDYWGQGTTVTVSS |

TABLE 27-continued

List of amino acid sequences of affinity matured hMAK199 VH variants

| Clone | SEQ ID NO: | VH |
|---|---|---|
| J647M2S1-41VH | 913 | EVQLVQSGAEVKKPGASVKVSCKASGYTFPNYGISWVRQAPGQGLEWMGWINTYTGEPSYAQGFTGRVTMTTDTSTSTAYMELSSLRSEDTAVYFCARKFLTTVVVTDYAMDYWGQGTTVTVSS |
| J647M2S1-43VH | 914 | EVQLVQSGAEVKKPGASVKVSCKASGYTFTNYGINWVRQAPGQGLEWMGWINTYTGEPSYAQGLTGRVTMTTDTSTSTAYMELSSLRSEDTAVYFCARKFLTTVVVTDYAMDYWGQGTTVTVSS |
| J647M2S1-45VH | 915 | EVQLVQSGAEVKKPGASVKVSCKASGYTFTKYGINWVRQAPGQGLEWMGWINTYTGEPTYAQGFTGRVTMTTDTSTSTAYMELSSLRSEDTAVYFCARKFLTTVVVTDYAMDYWGQGTTVTVSS |
| J647M2S1-47VH | 916 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKYLTTVVATDYAMDYWGQGTTVTVSS |
| J647M2S1-48VH | 917 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLNTVVVTDYAMDYWGQGTTVTVSS |
| J647M2S1-65VH | 918 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTPVVVTDCAMDYWGQGTTVTVSS |
| J647M2S1-66VH | 919 | EVQLVQSGAEVKKPGASVKVSCKASGYTFTNYGINWVRQAPGQGLEWMGWINTYTGEPRYAQGLTGRVTMTTDTSTSTAYMELSSLRSEDTAVYFCARKFLTTVVVTDYAMDYWGQGTTVTVSS |
| J647M2S1-67VH | 920 | EVQLVQSGAEVKKPGASVKVSCKASGYTFRDYGINWVRQAPGQGLEWMGWINTYTGLPTYAQGFTGRVTMTTDTSTSTAYMELSSLRSEDTAVYFCARKFLTTVVVTDYAMDYWGQGTTVTVSS |
| J647M2S1-69VH | 921 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFWTTIVVTDYAMDYWGQGTTVTVSS |
| J647M2S1-6VH | 922 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLTTVSATDNAMDYWGQGTTVTVSS |
| J647M2S1-70VH | 923 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLNTVVVTDYAMDYWGQGTTVTVSS |
| J647M2S1-72VH | 924 | EVQLVQSGAEVKKPGASVKVSCKASGYTFTDYGINWVRQAPGQGLEWMGWINTYNGEPSYAQGLTGRVTMTTDTSTSTAYMELSSLRSEDTAVYFCARKFLTTVVVTDYAMDYWGQGTTVTVSS |
| J647M2S1-75VH | 925 | EVQLVQSGAEVKKPGASVKVSCKASGYTFATYGIAWVRQAPGQGLEWMGWINTYSGVPKYAQGLTGRVTMTTDTSTSTAYMELSSLRSEDTAVYFCARKFLTTVVVTDYAMDYWGQGTTVTVSS |
| J647M2S1-76VH | 926 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFRTTAVPTDNAMDYWGQGTTVTVSS |
| J647M2S1-77VH | 927 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVNTDSAMDYWGQGTTVTVSS |

TABLE 27-continued

List of amino acid sequences of affinity matured hMAK199 VH variants

| Clone | SEQ ID NO: | VH |
|---|---|---|
| J647M2S1-78VH | 928 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLTTVVVTDYAMDYWGRGTTVTVSS |
| J647M2S1-79VH | 929 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLKTRVVTDYAMDYWGQGTTVTVSS |
| J647M2S1-7VH | 930 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLTTVVVTDYAMDYWGQGTTVTVSS |
| J647M2S1-80VH | 931 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLTTVVATDYAMDYWGQGTTVTVSS |
| J647M2S1-84VH | 932 | EVQLVQSGAEVKKPGASVKVSCKASGYTFTNYGINWVRQAPGQGLEWMGWINTYTGEPTYAQGFTGRVTMTTDTSTSTAYMELSSLRSEDTAVYFCARKFLTTVVVTDYAMDYWGQGTTVTVSS |
| J647M2S1-85VH | 933 | EVQLVQSGAEVKKPGASVKVSCKASGYTFTNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS |
| J647M2S1-87VH | 934 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFFPTMVVTDYAMDYWGQGTTVTVSS |
| J647M2S1-88VH | 935 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFVTTMVVTDYAMDYWGQGTTVTVSS |
| J647M2S1-8VH | 936 | EVQLVQSGAEVKKPGASVKVSCKASGYTFTNYGMNWVRQAPGQGLEWMGWINTYTGEPTYAQGLTGRVTMTTDTSTSTAYMELSSLRSEDTAVYFCARKFLTTVVVTDYAMDYWGQGTTVTVSS |
| J647M2S1-92VH | 937 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLTTIVATDNAMDYWGQGTTVTVSS |
| J647M2S1-93VH | 938 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLMSTVVETDNAMDYWGQGTTVTVSS |
| J647M2S1-94VH | 939 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLFTVVQTDYAMDYWGQGTTVTVSS |
| J647M2S1-96VH | 940 | EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLNTVVDTDYAMDYWGQGTTVTVSS |
| J662M2S3-14VH | 941 | EVQLVQSGAEVKKPGASVKVSCKASGYTFSNYGIIWVRQAPGQGLEWMGWINTYTGEPHYAQKLQGRVTMTTDTSTSTAYMELSSLRSEDTAVYFCARKLFTVEDVTDCAMDYWGQGTTVTVSS |
| J662M2S3-18VH | 942 | EVQLVQSGAEVKKPGASVKVSCKASGYTFDNYGMNWVRQAPGQGLEWMGWINTYNGKPTYAQKFQGRVTMTTDTSTSTAYMELSSLRSEDTAVYFCARKLFLVEAVTDYAMDYWGQGTTVTVSS |

TABLE 27-continued

List of amino acid sequences of affinity matured hMAK199 VH variants

| Clone | SEQ ID NO: | VH |
|---|---|---|
| J662M2S3-28VH | 943 | EVQLVQSGAEVKKPGASVKVSCKASGYTFRNYGIIWVRQAPGQGLEWMGWINTYTGKPTYAQKFQGRVTMTTDTSTSTAYMELSSLRSEDTAVYFCARKLFTTVDVTDNAMDYWGQGTTVTVSS |
| J662M2S3-29VH | 944 | EVQLVQSGAEVKKPGASVKVSCKASGYTFNNYGIIWVRQAPGQGLEWMGWINTYTGVPTYAQKFQGRVTMTTDTSTSTAYMELSSLRSEDTAVYYCARKLFNTVDVTDNAMDYWGQGTTVTVSS |
| J662M2S3-30VH | 945 | EVQLVQSGAEVKKPGASVKVSCKASGYTFNNYGIIWVRQAPGQGLEWMGWINTYTGEPHYAQKFQGRVTMTTDTSTSTAYMELSSLRSEDTAVYYCARKLFKTMAVTDAAMDYWGQGTTVTVSS |
| J662M2S3-34VH | 946 | EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFRNTVAVTDYAMDYWGQGTTVTVSS |
| J662M2S3-3VH | 947 | EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSS |
| J662M2S3-41VH | 948 | EVQLVQSGAEVKKPGASVKVSCKASGYTFTNYGINWVRQAPGQGLEWMGWINTYTGKPTYAQKFQGRVTMTTDTSTSTAYMELSSLRSEDTAVYYCARKLFFTEDVTDYAMDYWGQGTTVTVSS |
| J662M2S3-45VH | 949 | EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFFTPVVVTDNAMDYWGQGTTVTVSS |
| J662M2S3-55VH | 950 | EVQLVQSGAEVKKPGASVKVSCKASGYTFRNYGITWVRQAPGQGLEWMGWINTYTGKPTYAQKFQGRVTMTTDTSTSTAYMELSSLRSEDTAVYYCARKLFTTMDVTDNAMDYWGQGTTVTVSS |
| J662M2S3-5VH | 951 | EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS |
| J662M2S3-65VH | 952 | EVQLVQSGAEVKKPGASVKVSCKASGYTFNNYGIIWVRQAPGQGLEWMGWINTYTGKPTYAQKLQGRVTMTTDTSTSTAYMELSSLRSEDTAVYFCARKLFNTVDVTDNAMDYWGQGTTVTVSS |
| J662M2S3-78VH | 953 | EVQLVQSGAEVKKPGASVKVSCKASGYTFSNYGIIWVRQAPGQGLEWMGWINTYTGKPSYAQKFQGRVTMTTDTSTSTAYMELSSLRSEDTAVYYCARKLFNTVDVTDNAMDYWGQGTTVTVSS |
| J662M2S3-84VH | 954 | EVQLVQSGAEVKKPGASVKVSCKASGYTFSNYGINWVRQAPGQGLEWMGWINTYTGQPSYAQKFQGRVTMTTDTSTSTAYMELSSLRSEDTAVYYCARKLFKTEAVTDYAMDYWGQGTTVTVSS |
| J662M2S3-87VH | 955 | EVQLVQSGAEVKKPGASVKVSCKASGYTFNNYGIIWVRQAPGQGLEWMGWINTYSGKPTYAQKFQGRVTMTTDTSTSTAYMELSSLRSEDTAVYFCARKLFTTMDVTDNAMDYWGQGTTVTVSS |
| J662M2S3-96VH | 956 | EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKFFTTMAVTDNAMDYWGQGTTVTVSS |

Table 28 provides a list of amino acid sequences of VL regions of affinity matured fully human TNF antibodies derived from hMAK199 Amino acid residues of individual CDRs of each VL sequence are indicated in bold.

TABLE 28

List of amino acid sequences of affinity matured hMAK199 VL variants

| Clone | SEQ ID NO: | VL |
|---|---|---|
| J644M2S1-11Vk | 957 | DIQMTQSPSSLSASVGDRVTITCRASQDISNYLNWYQQK PGKAPKLLIYYTSRLQSGVPSRFSGSGSGTDYTLTISSL QPEDFATYYCQQGNTLPPTFGQGTKLEIK |
| J644M2S1-73Vk | 958 | DIQMTQSPSSLSASVGDRVTITCRASQDISNYLNWYQQK PGKAPKLLIYYASRLQSGVPSRFSGSGSGTDYTLTISSL QPEDFATYFCQQGNTLPPTFGQGTKLEIK |
| J647M2-11Vk | 959 | DIQMTQSPSSLSASVGDRVTITCRASQDISNYLNWYQQK PGKTVKLLIYYTSRLQSGVPSRFSGSGSGTDYTLTISSL QPEDFATYFCQQGNTLPPTFGQGTKLEIK |
| J647M2S1-10Vk | 960 | DIQMTQSPSSLSASVGDRVTITCRASQDIWNYLNWYQQK PGKAPKLLIYYTSRLQSGVPSRFSGSGSGTDFTLTISSL QPEDFATYFCQQGNRYPPTFGQGTKLEIK |
| J647M2S1-16Vk | 961 | DIQMTQSPSSLSASVGDRVTITCRASQDICTYLNWYQQK PGKAPKLLIYYTSRLQSGVPSRFSGSGSGTDFTLTISSL QPEDFATYYCQQGNSPPPTFGQGTKLEIK |
| J647M2S1-1Vk | 962 | DIQMTQSPSSLSASVGDRVTITCRASQAIGNYLNWYQQK PGKAPKLLIYYASRLQSGVPSRFSGSGSGTDFTLTISSL QPEDFATYFCQQGNTLPPTFGQGTKLEIK |
| J647M2S1-20Vk | 963 | DIQMTQSPSSLSASVGDRVTITCRASQDISNYLNWYQQK PGKAPKLLIYYTSRLQSGVPSRFSGSGSGTDYTLTISSL QPEDFATYFCQQGNTRPPTFGQGTKLEIK |
| J647M2S1-24Vk | 964 | DIQMTQSPSSLSASVGDRVTITCRASQDISNYLNWYQQK PGKAPKLLIYYTSLLQSGVPSRFSGSGSGTDYTLTISSL QPEDFATYYCQQGNTGPPTFGQGTKLEIK |
| J647M2S1-25Vk | 965 | DIQMTQSPSSLSASVGDRVTITCRASQDIYNYLNWYQQK PGKAPKLLIYYTSRLQSGVPSRFSGSGSGTDYTLTISSL QPEDFATYFCQQGNTLPPTFGQGTKLEIK |
| J647M2S1-29Vk | 966 | DIQMTQSPSSLSASVGDRVTITCRASQDISHYLNWYQQK PGKAPKLLIYYTSRLQSGVPSRFSGSGSGTDYTLTISSL QPEDFATYFCQQGNTLPATFGQGTKLEIK |
| J647M2S1-2Vk | 967 | DIQMTQSPSSLSASVGDRVTITCRASQDISSYLNWYQQK PGKTVKLLIYYASRLQSGVPSRFSGSGSGTDFTLTISSL QPEDFATYYCQQGNTPPPTFGQGTKLEIK |
| J647M2S1-34Vk | 968 | DIQMTQSPSSLSASVGDRVTITCRASQDISSYLNWYQQK PGKAPKLLIYYASRLQSGVPSRFSGSGSGTDFTLTISSL QPEDFATYYCQQGNTLPPTFGQGTKLEIK |
| J647M2S1-37Vk | 969 | DIQMTQSPSSLSASVGDRVTITCRASQEISNYLNWYQQK PGKAPKLLIYYTSRLQSGVPSRFSGSGSGTDYTLTISSL QPEDFATYFCQQGNTMPTTFGQGTKLEIK |
| J647M2S1-38Vk | 970 | DIQMTQSPSSLSASVGDRVTITCRASQDISNYLNWYQQK PGKAPKLLIYFASRLQSGVPSRFSGSGSGTDYTLTISSL QPEDFATYFCQQGNTPPTTFGQGTKLEIK |
| J647M2S1-3Vk | 971 | DIQMTQSPSSLSASVGDRVTITCRASQDISNYLNWYQQK PGKAPKLLIYYTSRLQSGVPSRFSGSGSGTDYTLTISSL QPEDFATYFCQQGNTLPSTFGQGTKLEIK |
| J647M2S1-42Vk | 972 | DIQMTQSPSSLSASVGDRVTITCRASQVISNTLNWYQQK PGKAPKLLIYYTSRLQSGVPSRFSGSGSGTDYTLTISSL QPEDFATYFCQQGNALPPTFGQGTKLEIK |
| J647M2S1-44Vk | 973 | DIQMTQSPSSLSASVGDRVTITCRASQDISTYLNWYQQK PGKAPKLLIYYTSRLQSGVPSRFSGSGSGTDFTLTISSL QPEDFATYFCQQGNTPPPTFGQGTKLEIK |
| J647M2S1-46Vk | 974 | DIQMTQSPSSLSASVGDRVTITCRASQDISQYLNWYQQK PGKAPKLLIYYTSRLQSGVPSRFSGSGSGTDYTLTISSL QPEDFATYYCQQGNTLPPTFGQGTKLEIK |
| J647M2S1-50Vk | 975 | DIQMTQSPSSLSASVGDRVTITCRASQDITNYLNWYQQK PGKAPKLLIYYTSRLQSGVPSRFSGSGSGTDFTLTISSL QPEDFATYYCQQGNTAPPTFGQGTKLEIK |

TABLE 28-continued

List of amino acid sequences of affinity matured hMAK199 VL variants

| Clone | SEQ ID NO: | VL |
|---|---|---|
| J647M2S1-52Vk | 976 | DIQMTQSPSSLSASVGDRVTITCRASQGISNYLNWYQQK PGKAPKLLIYYTSRLQSGVPSRFSGSGSGTDYTLTISSL QPEDFATYFCQQGNTMPPTFGQGTKLEIK |
| J647M2S1-56Vk | 977 | DIQMTQSPSSLSASVGDRVTITCRASQDISNYLNWYQQK PGKAPKLLIYYTSRLQSGVPSRFSGSGSGTDFTLTISSL QPEDFATYFCQQGNTLPPTFGQGTKLEIK |
| J647M2S1-59Vk | 978 | DIQMTQSPSSLSASVGDRVTITCRASQDISKYLNWYQQK PGKAPKLLIYYTSRLQSGVPSRFSGSGSGTDFTLTISSL QPEDFATYYCQQGNTRPPTFGQGTKLEIK |
| J647M2S1-71Vk | 979 | DIQMTQSPSSLSASVGDRVTITCRASQDISNYLNWYQQK PGKAPKLLIYYTSLLQSGVPSRFSGSGSGTDFTLTISSL QPEDFATYYCQQGNTQPPTFGQGTKLEIK |
| J647M2S1-74Vk | 980 | DIQMTQSPSSLSASVGDRVTITCRASQDISNYLNWYQQK PGKAPKLLIYYTSRLQSGVPSRFSGSGSGTDFTLTISSL QPEDFATYYCQQGNSQPPTFGQGTKLEIK |
| J647M2S1-78Vk | 981 | DIQMTQSPSSLSASVGDRVTITCRASQDISKYLNWYQQK PGKAPKLLIYNASRLQSGVPSRFSGSGSGTDFTLTISSL QPEDFATYFCQQGNTLPPTFGQGTKLEIK |
| J647M2S1-7Vk | 982 | DIQMTQSPSSLSASVGDRVTITCRASQDISNYLNWYQQK PGKAPKLLIYYTSLLQSGVPSRFSGSGSGTDFTLTISSL QPEDFATYYCQQGNIWPPTFGQGTKLEIK |
| J647M2S1-9Vk | 983 | DIQMTQSPSSLSASVGDRVTITCRASQDISHYLNWYQQK PGKAPKLLIYYTSRLQSGVPSRFSGSGSGTDYTLTISSL QPEDFATYFCQQGNTLPPTFGQGTKLEIK |
| J652M2S1-10Vk | 984 | DIQMTQSPSSLSASVGDRVTITCRASQDISNYLNWYQQK PGKAPKLLIYYTSRLQSGVPSRFSGSGSGTDYTLTISSL QPEDFATYYCQQGNTFPPTFGQGTKLEIK |
| J652M2S1-13Vk | 985 | DIQMTQSPSSLSASVGDRVTITCRASQDISNYLNWYQQK PGKAPKLLIYYTSRLQSGVPSRFSGSGSGTDYTLTISSL QPEDFATYFCQQGNTQPPTFGQGTKLEIK |
| J652M2S1-14Vk | 986 | DIQMTQSPSSLSASVGDRVTITCRASQDISNVLNWYQQK PGKAPKLLIYYASRLQSGVPSRFSGSGSGTDFTLTISSL QPEDFATYYCQQGNTLPPTFGQGTKLEIK |
| J652M2S1-15Vk | 987 | DIQMTQSPSSLSASVGDRVTITCRASQDIYKYLNWYQQK PGKAPKLLIYYTSRLQSGVPSRFSGSGSGTDFTLTISSL QPEDFATYYCQQGNTMPPTFGQGTKLEIK |
| J652M2S1-17Vk | 988 | DIQMTQSPSSLSASVGDRVTITCRASQEIFSYLNWYQQK PGKAPKLLIYYTSRLQSGVPSRFSGSGSGTDFTLTISSL QPEDFATYYCQQGNMGPPTFGQGTKLEIK |
| J652M2S1-18Vk | 989 | DIQMTQSPSSLSASVGDRVTITCRASQDISNYLNWYQQK PGKAPKLLIYYTSRLQSGVPSRFSGSGSGTDYTLTISSL QPEDFATYYCQQGNTQPPTFGQGTKLEIK |
| J652M2S1-1Vk | 990 | DIQMTQSPSSLSASVGDRVTITCRASQDISSYLNWYQQK PGKAPKLLIYYASRLQSGVPSRFSGSGSGTDFTLTISSL QPEDFATYYCQQGNTWPPTFGQGTKLEIK |
| J652M2S1-22Vk | 991 | DIQMTQSPSSLSASVGDRVTITCRASQDISNYLNWYQQK PGKAPKLLIYYTSRLQSGVPSRFSGSGSGTDFTLTISSL QPEDFATYYCQQGNTRPPTFGQGTKLEIK |
| J652M2S1-23Vk | 992 | DIQMTQSPSSLSASVGDRVTITCRASQDISNFLNWYQQK PGKAPKLLIYYASRLQSGVPSRFSGSGSGTDFTLTISSL QPEDFATYFCQQGNTFPPTFGQGTKLEIK |
| J652M2S1-25Vk | 993 | DIQMTQSPSSLSASVGDRVTITCRASQDISNFLNWYQQK PGKAPKLLIYYTSRLQSGVPSRFSGSGSGTDYTLTISSL QPEDFATYFCQQGNTRPPTFGQGTKLEIK |
| J652M2S1-26Vk | 994 | DIQMTQSPSSLSASVGDRVTITCRASQDINNYLNWYQQK PGKAPKLLIYYTSRLQSGVPSRFSGSGSGTDFTLTISSL QPEDFATYFCQQGNTQPPTFGQGTKLEIK |

TABLE 28-continued

List of amino acid sequences of affinity matured hMAK199 VL variants

| Clone | SEQ ID NO: | VL |
|---|---|---|
| J652M2S1-27Vk | 995 | DIQMTQSPSSLSASVGDRVTITCRASQDISNYLNWYQQK PGKAPKLLIYYASGLQSGVPSRFSGSGSGTDYTLTISSL QPEDFATYFCQQGNTWPPTFGQGTKLEIK |
| J652M2S1-28Vk | 996 | DIQMTQSPSSLSASVGDRVTITCRASQDISRYLNWYQQK PGKAPKLLIYYTSRLQSGVPSRFSGSGSGTDFTLTISSL QPEDFATYYCQQGNTQPPTFGQGTKLEIK |
| J652M2S1-29Vk | 997 | DIQMTQSPSSLSASVGDRVTITCRASQDIATYLNWYQQK PGKAPKLLIYYTSRLQSGVPSRFSGSGSGTDFTLTISSL QPEDFATYFCQQGNTMPPTFGQGTKLEIK |
| J652M2S1-31Vk | 998 | DIQMTQSPSSLSASVGDRVTITCRASQDISNYLNWYQQK PGKAPKLLIYYTSRLQSGVPSRFSGSGSGTDYTLTISSL QPEDFATYFCQQGNTFPPTFGQGTKLEIK |
| J652M2S1-33Vk | 999 | DIQMTQSPSSLSASVGDRVTITCRASQRIGNYLNWYQQK PGKTVKLLIYYASRLQSGVPSRFSGSGSGTDFTLTISSL QPEDFATYFCQQGNTLPPTFGQGTKLEIK |
| J652M2S1-34Vk | 1000 | DIQMTQSPSSLSASVGDRVTITCRASQEISNYLNWYQQK PGKAPKLLIYYTSRLQSGVPSRFSGSGSGTDYTLTISSL QPEDFATYYCQQGNSQPPTFGQGTKLEIK |
| J652M2S1-35Vk | 1001 | DIQMTQSPSSLSASVGDRVTITCRASQDIANYLNWYQQK PGKAPKLLIYYTSRLQSGVPSRFSGSGSGTDFTLTISSL QPEDFATYYCQQGNTLPPTFGQGTKLEIK |
| J652M2S1-37Vk | 1002 | DIQMTQSPSSLSASVGDRVTITCRASQDISNYLNWYQQK PGKAPKLLIYYASRLQSGVPSRFSGSGSGTDYTLTISSL QPEDFATYFCQQGNTFPPTFGQGTKLEIK |
| J652M2S1-38Vk | 1003 | DIQMTQSPSSLSASVGDRVTITCRASQDISNYLNWYQQK PGKAPKLLIYYTSRLQSGVPSRFSGSGSGTDFTLTISSL QPEDFATYYCQQGNTQPPTFGQGTKLEIK |
| J652M2S1-3Vk | 1004 | DIQMTQSPSSLSASVGDRVTITCRASQDISNYLNWYQQK PGKAPKLLIYYTSRLQSGVPSRFSGSGSGTDYTLTISSL QPEDFATYFCQQGNTPPPTFGQGTKLEIK |
| J652M2S1-40Vk | 1005 | DIQMTQSPSSLSASVGDRVTITCRASQDISNFLNWYQQK PGKAPKLLIYYTSRLQSGVPSRFSGSGSGTDYTLTISSL QPEDFATYYCQQGNTLPPTFGQGTKLEIK |
| J652M2S1-41Vk | 1006 | DIQMTQSPSSLSASVGDRVTITCRASQDIGNFLNWYQQK PGKAPKLLIYYTSRLQSGVPSRFSGSGSGTDYTLTISSL QPEDFATYFCQQGNTRPPTFGQGTKLEIK |
| J652M2S1-42Vk | 1007 | DIQMTQSPSSLSASVGDRVTITCRASQDITNYLNWYQQK PGKAPKLLIYYTSRLQSGVPSRFSGSGSGTDYTLTISSL QPEDFATYYCQQGNTPPPTFGQGTKLEIK |
| J652M2S1-45Vk | 1008 | DIQMTQSPSSLSASVGDRVTITCRASQDISDYLNWYQQK PGKAPKLLIYYTSRLQSGVPSRFSGSGSGTDFTLTISSL QPEDFATYFCQQGNMWPPTFGQGTKLEIK |
| J652M2S1-47Vk | 1009 | DIQMTQSPSSLSASVGDRVTITCRASQDISSYLNWYQQK PGKAPKLLIYYASRLQSGVPSRFSGSGSGTDFTLTISSL QPEDFATYFCQQGNTMPPTFGQGTKLEIK |
| J652M2S1-48Vk | 1010 | DIQMTQSPSSLSASVGDRVTITCRASQDISHYLNWYQQK PGKAPKLLIYYTSRLQSGVPSRFSGSGSGTDFTLTISSL QPEDFATYYCQQGNTLPPTFGQGTKLEIK |
| J652M2S1-49Vk | 1011 | DIQMTQSPSSLSASVGDRVTITCRASQDISNYLNWYQQK PGKAPKLLIYYASRLQSGVPSRFSGSGSGTDFTLTISSL QPEDFATYFCQQGNTMPPTFGQGTKLEIK |
| J652M2S1-51Vk | 1012 | DIQMTQSPSSLSASVGDRVTITCRASQDISQYLNWYQQK PGKAPKLLIYYTSRLQSGVPSRFSGSGSGTDFTLTISSL QPEDFATYFCQQGNTRPPTFGQGTKLEIK |
| J652M2S1-52Vk | 1013 | DIQMTQSPSSLSASVGDRVTITCRASQDISNYLNWYQQK PGKAPKLLIYYTSRLQSGVPSRFSGSGSGTDYTLTISSL QPEDFATYFCQQGNMRPPTFGQGTKLEIK |

TABLE 28-continued

List of amino acid sequences of affinity matured hMAK199 VL variants

| Clone | SEQ ID NO: | VL |
|---|---|---|
| J652M2S1-53Vk | 1014 | DIQMTQSPSSLSASVGDRVTITCRASQDISTYLNWYQQKPGKAPKLLIYYASRLQSGVPSRFSGSGSGTDFTLTISSLQPEDFATYFCQQGNTLPPTFGQGTKLEIK |
| J652M2S1-55Vk | 1015 | DIQMTQSPSSLSASVGDRVTITCRASQDISNYLNWYQQKPGKAPKLLIYYTSRLQSGVPSRFSGSGSGTDYTLTISSLQPEDFATYFCQQGNTGPPTFGQGTKLEIK |
| J652M2S1-56Vk | 1016 | DIQMTQSPSSLSASVGDRVTITCRASQNINNYLNWYQQKPGKAPKLLIYYTSRLQSGVPSRFSGSGSGTDYTLTISSLQPEDFATYFCQQGNTMPPTFGQGTKLEIK |
| J652M2S1-57Vk | 1017 | DIQMTQSPSSLSASVGDRVTITCRASQDISKYLNWYQQKPGKAPKLLIYYTSRLQSGVPSRFSGSGSGTDYTLTISSLQPEDFATYYCQQGNTPPPTFGQGTKLEIK |
| J652M2S1-61Vk | 1018 | DIQMTQSPSSLSASVGDRVTITCRASQDISNYLNWYQQKPGKAPKLLIYYTSRLQSGVPSRFSGSGSGTDFTLTISSLQPEDFATYYCQQGNTVPPTFGQGTKLEIK |
| J652M2S1-62Vk | 1019 | DIQMTQSPSSLSASVGDRVTITCRASQDISNYLNWYQQKPGKAPKLLIYYTSKLQSGVPSRFSGSGSGTDYTLTISSLQPEDFATYFCQQGNIFPPTFGQGTKLEIK |
| J652M2S1-64Vk | 1020 | DIQMTQSPSSLSASVGDRVTITCRASQGIYNYLNWYQQKPGKAPKLLIYYTSRLQSGVPSRFSGSGSGTDYTLTISSLQPEDFATYFCQQGNTLPPTFGQGTKLEIK |
| J652M2S1-67Vk | 1021 | DIQMTQSPSSLSASVGDRVTITCRASQDISSYLNWYQQKPGKAPKLLIYYTSRLQSGVPSRFSGSGSGTDFTLTISSLQPEDFATYYCQQGNTLPPTFGQGTKLEIK |
| J652M2S1-69Vk | 1022 | DIQMTQSPSSLSASVGDRVTITCRASQEISNYLNWYQQKPGKAPKLLIYYTSRLQSGVPSRFSGSGSGTDYTLTISSLQPEDFATYFCQQGNTGPPTFGQGTKLEIK |
| J652M2S1-6Vk | 1023 | DIQMTQSPSSLSASVGDRVTITCRASQDISNYLNWYQQKPGKAPKLLIYYTSRLQSGVPSRFSGSGSGTDFTLTISSLQPEDFATYYCQQGNTPPPTFGQGTKLEIK |
| J652M2S1-71Vk | 1024 | DIQMTQSPSSLSASVGDRVTITCRASQDISDYLNWYQQKPGKAPKLLIYYTSRLQSGVPSRFSGSGSGTDYTLTISSLQPEDFATYYCQQGNTWPPTFGQGTKLEIK |
| J652M2S1-73Vk | 1025 | DIQMTQSPSSLSASVGDRVTITCRASQDIWKYLNWYQQKPGKAPKLLIYYASRLQSGVPSRFSGSGSGTDFTLTISSLQPEDFATYYCQQGNTLPPTFGQGTKLEIK |
| J652M2S1-75Vk | 1026 | DIQMTQSPSSLSASVGDRVTITCRASQDISTYLNWYQQKPGKAPKLLIYYTSRLQSGVPSRFSGSGSGTDYTLTISSLQPEDFATYYCQQGNTWPPTFGQGTKLEIK |
| J652M2S1-77Vk | 1027 | DIQMTQSPSSLSASVGDRVTITCRASQDISNYLNWYQQKPGKAPKLLIYYTSRLQSGVPSRFSGSGSGTDYTLTISSLQPEDFATYYCQQGNTPPPTFGQGTKLEIK |
| J652M2S1-78Vk | 1028 | DIQMTQSPSSLSASVGDRVTITCRASQDISNYLNWYQQKPGKAPKLLIYYTSRLQSGVPSRFSGSGSGTDFTLTISSLQPEDFATYFCQQGNAPPPTFGQGTKLEIK |
| J652M2S1-79Vk | 1029 | DIQMTQSPSSLSASVGDRVTITCRASQDIYKFLNWYQQKPGKAPKLLIYYTSRLQSGVPSRFSGSGSGTDYTLTISSLQPEDFATYFCQQGNTLPPTFGQGTKLEIK |
| J652M2S1-80Vk | 1030 | DIQMTQSPSSLSASVGDRVTITCRASQDIFNYLNWYQQKPGKAPKLLIYYTSRLQSGVPSRFSGSGSGTDYTLTISSLQPEDFATYFCQQGNTLPPTFGQGTKLEIK |
| J652M2S1-82Vk | 1031 | DIQMTQSPSSLSASVGDRVTITCRASQDISNTLNWYQQKPGKAPKLLIYYASRLQSGVPSRFSGSGSGTDFTLTISSLQPEDFATYFCQQGNTLPPTFGQGTKLEIK |
| J652M2S1-84Vk | 1032 | DIQMTQSPSSLSASVGDRVTITCRASQHISNYLNWYQQKPGKAPKLLIYYTSRLQSGVPSRFSGSGSGTDYTLTISSLQPEDFATYFCQQGNTQPPTFGQGTKLEIK |

TABLE 28-continued

List of amino acid sequences of affinity matured hMAK199 VL variants

| Clone | SEQ ID NO: | VL |
|---|---|---|
| J652M2S1-86Vk | 1033 | DIQMTQSPSSLSASVGDRVTITCRASQDISNYLNWYQQK PGKAPKLLIYYTSRLQSGVPSRFSGSGSGTDYTLTISSL QPEDFATYFCQQGNMPPPTFGQGTKLEIK |
| J652M2S1-87Vk | 1034 | DIQMTQSPSSLSASVGDRVTITCRASQDITNYLNWYQQK PGKAPKLLIYYTSRLQSGVPSRFSGSGSGTDFTLTISSL QPEDFATYFCQQGNTVPPTFGQGTKLEIK |
| J652M2S1-8Vk | 1035 | DIQMTQSPSSLSASVGDRVTITCRASQDISNYLNWYQQK PGKAPKLLIYFTSRLQSGVPSRFSGSGSGTDFTLTISSL QPEDFATYYCQQGNTQPPTFGQGTKLEIK |
| J652M2S1-90Vk | 1036 | DIQMTQSPSSLSASVGDRVTITCRASQDISKFLNWYQQK PGKAPKLLIYYTSRLQSGVPSRFSGSGSGTDYTLTISSL QPEDFATYYCQQGNTRPPTFGQGTKLEIK |
| J652M2S1-91Vk | 1037 | DIQMTQSPSSLSASVGDRVTITCRASQDISNYLNWYQQK PGKAPKLLIYYTSRLQSGVPSRFSGSGSGTDFTLTISSL QPEDFATYFCQQGNTFPPTFGQGTKLEIK |
| J652M2S1-92Vk | 1038 | DIQMTQSPSSLSASVGDRVTITCRASQDIYNVLNWYQQK PGKAPKLLIYYASRLQSGVPSRFSGSGSGTDFTLTISSL QPEDFATYFCQQGITLPPTFGQGTKLEIK |
| J652M2S1-93Vk | 1039 | DIQMTQSPSSLSASVGDRVTITCRASQHISNYLNWYQQK PGKAPKLLIYYTSRLQSGVPSRFSGSGSGTDYTLTISSL QPEDFATYFCQQGNTWPPTFGQGTKLEIK |
| J652M2S1-95Vk | 1040 | DIQMTQSPSSLSASVGDRVTITCRASQDISNYLNWYQQK PGKAPKLLIYYTSRLQSGVPSRFSGSGSGTDYTLTISSL QPEDFATYFCQQGNTQPSTFGQGTKLEIK |
| J652M2S1-9Vk | 1041 | DIQMTQSPSSLSASVGDRVTITCRASQDISNYLNWYQQK PGKAPKLLIYYTSRLQSGVPSRFSGSGSGTDFTLTISSL QPEDFATYFCQQGNTQPPTFGQGTKLEIK |
| J662M2S3-13Vk | 1042 | DIQMTQSPSSLSASVGDRVTITCRASQDISNYLNWYQQK PGKAPKLLIYYTSRLQSGVPSRFSGSGSGTDYTLTISSL QPEDFATYFCQQGNSWPPTFGQGTKLEIK |
| J662M2S3-15Vk | 1043 | DIQMTQSPSSLSASVGDRVTITCRASQDIYNYLNWYQQK PGKAPKLLIYYTSRLQSGVPSRFSGSGSGTDYTLTISSL QPEDFATYFCQQGNTQPPTFGQGTKLEIK |
| J662M2S3-21Vk | 1044 | DIQMTQSPSSLSASVGDRVTITCRASQDISNYLNWYQQK PGKAPKLLIYYTSRLQSGVPSRFSGSGSGTDYTLTISSL QPEDFATYFCQQGNTWPPTFGQGTKLEIK |
| J662M2S3-22Vk | 1045 | DIQMTQSPSSLSASVGDRVTITCRASQDISQYLNWYQQK PGKAPKLLIYYTSRLQSGVPSRFSGSGSGTDFTLTISSL QPEDFATYFCQQGNTWPPTFGQGTKLEIK |
| J662M2S3-34Vk | 1046 | DIQMTQSPSSLSASVGDRVTITCRASQDIYDVLNWYQQK PGKAPKLLIYYASRLQSGVPSRFSGSGSGTDFTLTISSL QPEDFATYYCQQGITLPPTFGQGTKLEIK |
| J662M2S3-3Vk | 1047 | DIQMTQSPSSLSASVGDRVTITCRASQDIENYLNWYQQK PGKAPKLLIYYTSRLQSGVPSRFSGSGSGTDFTLTISSL QPEDFATYFCQQGNTQPPTFGQGTKLEIK |
| J662M2S3-41Vk | 1048 | DIQMTQSPSSLSASVGDRVTITCRASQNIENFLNWYQQK PGKAPKLLIYYTSRLQSGVPSRFSGSGSGTDFTLTISSL QPEDFATYFCQQGNTWPPTFGQGTKLEIK |
| J662M2S3-56Vk | 1049 | DIQMTQSPSSLSASVGDRVTITCRASQDIYNYLNWYQQK PGKAPKLLIYYTSRLQSGVPSRFSGSGSGTDYTLTISSL QPEDFATYFCQQGNTPPPTFGQGTKLEIK |
| J662M2S3-64Vk | 1050 | DIQMTQSPSSLSASVGDRVTITCRASQDIASYLNWYQQK PGKAPKLLIYYTSRLQSGVPSRFSGSGSGTDFTLTISSL QPEDFATYFCQQGNTQPPTFGQGTKLEIK |
| J662M2S3-78Vk | 1051 | DIQMTQSPSSLSASVGDRVTITCRASQDISNYLNWYQQK PGKVPKLLIYYTSRLQSGVPSRFSGSGSGTDYTLTISSL QPEDFATYFCQQGNTQPPTFGQGTKLEIK |

TABLE 28-continued

List of amino acid sequences of affinity matured hMAK199 VL variants

| Clone | SEQ ID NO: | VL |
|---|---|---|
| J662M2S3-84Vk | 1052 | DIQMTQSPSSLSASVGDRVTITCRASQNIYNVLNWYQQKPGKAPKLLIYYASRLQSGVPSRFSGSGSGTDFTLTISSLQPEDFATYFCQQGNTMPPTFGQGTKLEIK |

TABLE 29

Amino acid residues observed in affinity matured hMAK-199 antibodies

MAK199 Heavy chain variable region (SEQ ID NO: 1077)

```
MAK199VH.2a 1234567890123456789012345678901234567890123456789012a345678901
            EIQLVQSGAEVKKPGASVKVSCKASGYTFTNYGMNWVRQAPGQGLEWMGWINTYTGEPTYAD
            V                           ND  II                     N K S  Q
                                        AH  T                      S V H
                                        ST  Q                      Q   N
                                        RS  S                      R   M
                                        DQ  G                      L   K
                                        KK  A                      S   A
                                        P   V                      N   R
                                        Q                          I   Q
                                        M                          D   D
                                        G                          A
                                        E
            34567890123456789012abc345678901234567890abcdefg12345678901234
            DFKGRFTFTLDTSTSTAYMELSSLRSEDTAVYFCARKFLTTVVVTDYAMDYWGQGTTVTVSS
            GLT  V M T               Y   RLFNPMDASENT
            K Q                          NYMKVEAEM  SR
                                         IRSSAEMN   CC
                                         VSRARSD    H
                                         CWL IMG    D
                                         QP  QII    I
                                         VF  GPQ    F
                                         ND  D P    V
                                         GM    N    L
                                         CA    L    A
                                               H
```

Mak199 Light chain variable region (SEQ ID NO: 1078)

```
Mak199Vk.1a 12345678901234567890123456789012345678901234567890123456789Ol
            DIQMTQSPSSLSASVGDRVTITCRASQDISNYLNWYQQKPGKTVKLLIYYTSRLQSGVPSR
                                   N  YQV         AP       FA    L
                                   E  ESF         V        N     K
                                   H  AKT                        G
                                   G  TT
                                   V  WH
                                   R  GD
                                   A  NR
                                      F
                                      C
            23456789012345678901234567890123456789012345678901234567
            FSGSGSGTDYTLTISSLQPEDFATYFCQQGNTLPPTFGQGTKLEIK
                    F                Y   ISW  T
                                        MQ   S
                                        IP   A
                                        AM
                                        RR
                                         F
                                         G
                                         V
                                         Y
                                         A
```

TABLE 30

Individual hMAK-199 VII sequences from converted clones

| Protein region | SEQ ID NO: | Sequence<br>12345678901234567890123456 7890 |
|---|---|---|
| J662M2S3 #10 VH | 1053 | EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS |
| J662M2S3# 10 VH | CDR-H1 Residues 31-35 of SEQ ID NO.: 1053 | NYGII |
| J662M2S3# 10 VH | CDR-H2 Residues 50-66 of SEQ ID NO.: 1053 | WINTYTGKPTYAQKFQG |
| J662M2S3# 10 VH | CDR-H3 Residues 99-112 of SEQ ID NO.: 1053 | RASQDISQYLN |
| J662M2S3# 13 VH | 1054 | EVQLVQSGAEVKKPGASVKVSCKASGYTFNNYGIIWVRQAPGQGLEWMGWINTYTGKPTYAQKLQGRVTMTTDTSTSTAYMELSSLRSEDTAVYFCARKLFNTVDVTDNAMDYWGQGTTVTVSS |
| J662M2S3# 13 VH | CDR-H1 Residues 31-35 of SEQ ID NO.: 1054 | NYGII |
| J662M2S3# 13 VH | CDR-H2 Residues 50-66 of SEQ ID NO.: 1054 | WINTYTGKPTYAQKLQG |
| J662M2S3# 13 VH | CDR-H3 Residues 99-112 of SEQ ID NO.: 1054 | KLFNTVDVTDNAMD |
| J662M2S3# 15 VH | 1055 | EVQLVQSGAEVKKPGASVKVSCKASGYTFNNYGIIWVRQAPGQGLEWMGWINTYTGVPTYAQKFQGRVTMTTDTSTSTAYMELSSLRSEDTAVYYCARKLFNTVDVTDNAMDYWGQGTTVTVSS |
| J662M2S3# 15 VH | CDR-H1 Residues 31-35 of SEQ ID NO.: 1055 | NYGII |
| J662M2S3# 15 VH | CDR-H2 Residues 50-66 of SEQ ID NO.: 1055 | WINTYTGVPTYAQKFQG |
| J662M2S3# 15 VH | CDR-H3 Residues 99-112 of SEQ ID NO.: 1055 | KLFNTVDVTDNAMD |
| J662M2S3# 16 VH | 1056 | EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSS |
| J662M2S3# 16 VH | CDR-H1 Residues 31-35 of SEQ ID NO.: 1056 | NYGII |
| J662M2S3# 16 VH | CDR-H2 Residues 50-66 of SEQ ID NO.: 1056 | WINTYTGKPTYAQKFQG |
| J662M2S3# 16 VH | CDR-H3 Residues 99-112 of SEQ ID NO.: 1056 | KLFNTVAVTDNAMD |
| J662M2S3# 21 VH | 1057 | EVQLVQSGAEVKKPGASVKVSCKASGYTFRNYGIIWVRQAPGQGLEWMGWINTYTGKPTYAQKFQGRVTMTTDTSTSTAYMELSSLRSEDTAVYFCARKLFTTVDVTDNAMDYWGQGTTVTVSS |
| J662M2S3# 21 VH | CDR-H1 Residues 31-35 of SEQ ID NO.: 1057 | NYGII |
| J662M2S3# 21 VH | CDR-H2 Residues 50-66 of SEQ ID NO.: 1057 | WINTYTGKPTYAQKFQG |
| J662M2S3# 21 VH | CDR-H3 Residues 99-112 of SEQ ID NO.: 1057 | KLFTTVDVTDNAMD |

TABLE 30-continued

Individual hMAK-199 VII sequences from converted clones

| Protein region | SEQ ID NO: | Sequence 12345678901234567890123456789 0 |
|---|---|---|
| J662M2S3# 34 VH | 1058 | EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFRNTVAVTDYAMDYWGQGTTVTVSS |
| J662M2S3# 34 VH | CDR-H1 Residues 31-35 of SEQ ID NO.: 1058 | NYGIN |
| J662M2S3# 34 VH | CDR-H2 Residues 50-66 of SEQ ID NO.: 1058 | WINTYTGKPTYAQKFQG |
| J662M2S3# 34 VH | CDR-H3 Residues 99-112 of SEQ ID NO.: 1058 | KFRNTVAVTDYAMD |
| J662M2S3# 36 VH | 1059 | EVQLVQSGAEVKKPGASVKVSCKASGYTFRNYGITWVRQAPGQGLEWMGWINTYTGKPTYAQKFQGRVTMTTDTSTSTAYMELSSLRSEDTAVYFCARKLFTTMDVTDNAMDYWGQGTTVTVSS |
| J662M2S3# 36 VH | CDR-H1 Residues 31-35 of SEQ ID NO.: 1059 | NYGIT |
| J662M2S3# 36 VH | CDR-H2 Residues 50-66 of SEQ ID NO.: 1059 | WINTYTGKPTYAQKFQG |
| J662M2S3# 36 VH | CDR-H3 Residues 99-112 of SEQ ID NO.: 1059 | KLFTTMDVTDNAMD |
| J662M2S3# 45 VH | 1060 | EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS |
| J662M2S3# 45 VH | CDR-H1 Residues 31-35 of SEQ ID NO.: 1060 | NYGII |
| J662M2S3# 45 VH | CDR-H2 Residues 50-66 of SEQ ID NO.: 1060 | WINTYTGKPTYAQKFQG |
| J662M2S3# 45 VH | CDR-H3 Residues 99-112 of SEQ ID NO.: 1060 | KLFTTMDVTDNAMD |
| J662M2S3# 58 VH | 1061 | EVQLVQSGAEVKKPGASVKVSCKASGYTFSNYGINWVRQAPGQGLEWMGWINTYTGQPSYAQKFQGRVTMTTDTSTSTAYMELSSLRSEDTAVYYCARKLFKTEAVTDYAMDYWGQGTTVTVSS |
| J662M2S3# 58 VH | CDR-H1 Residues 31-35 of SEQ ID NO.: 1061 | NYGIN |
| J662M2S3# 58 VH | CDR-H2 Residues 50-66 of SEQ ID NO.: 1061 | WINTYTGQPSYAQKFQG |
| J662M2S3# 58 VH | CDR-H3 Residues 99-112 of SEQ ID NO.: 1061 | KLFKTEAVTDYAMD |
| J662M2S3# 72 VH | 1062 | EVQLVQSGAEVKKPGASVKVSCKASGYTFNNYGIIWVRQAPGQGLEWMGWINTYSGKPTYAQKFQGRVTMTTDTSTSTAYMELSSLRSEDTAVYFCARKLFTTMDVTDNAMDYWGQGTTVTVSS |
| J662M2S3# 72 VH | CDR-H1 Residues 31-35 of SEQ ID NO.: 1062 | NYGII |
| J662M2S3# 72 VH | CDR-H2 Residues 50-66 of SEQ ID NO.: 1062 | WINTYSGKPTYAQKFQG |
| J662M2S3# 72 VH | CDR-H3 Residues 99-112 of SEQ ID NO.: 1062 | KLFTTMDVTDNAMD |

TABLE 31

| | Individual hMAK-199 clones VL sequences | |
|---|---|---|
| Protein region | SEQ ID NO: | Sequence<br>12345678901234567890123456789 0 |
| J662M2S3#10 VL | 1063 | DIQMTQSPSSLSASVGDRVTITCRASQDIS QYLNWYQQKPGKAPKLLIYYTSRLQSGVPS RFSGSGSGTDFTLTISSLQPEDFATYFCQQ GNTWPPTFGQGTKLEIK |
| J662M2S3#10 VL | CDR-L1 Residues 24-34 of SEQ ID NO.: 1063 | RASQDISQYLN |
| J662M2S3#10 VL | CDR-L2 Residues 50-56 of SEQ ID NO.: 1063 | YTSRLQS |
| J662M2S3#10 VL | CDR-L3 Residues 89-97 of SEQ ID NO.: 1063 | QQGNTWPPT |
| J662M2S3#13 VL | 1064 | DIQMTQSPSSLSASVGDRVTITCRASQDIS NYLNWYQQKPGKAPKLLIYYTSRLQSGVPS RFSGSGSGTDYTLTISSLQPEDFATYFCQQ GNSWPPTFGQGTKLEIK |
| J662M2S3#13 VL | CDR-L1 Residues 24-34 of SEQ ID NO.: 1064 | RASQDISNYLN |
| J662M2S3#13 VL | CDR-L2 Residues 50-56 of SEQ ID NO.: 1064 | YTSRLQS |
| J662M2S3#13 VL | CDR-L3 Residues 89-97 of SEQ ID NO.: 1064 | QQGNSWPPT |
| J662M2S3#15 VL | 1065 | DIQMTQSPSSLSASVGDRVTITCRASQDIY NYLNWYQQKPGKAPKLLIYYTSRLQSGVPS RFSGSGSGTDYTLTISSLQPEDFATYFCQQ GNTQPPTFGQGTKLEIK |
| J662M2S3#15 VL | CDR-L1 Residues 24-34 of SEQ ID NO.: 1065 | RASQDIYNYLN |
| J662M2S3#15 VL | CDR-L2 Residues 50-56 of SEQ ID NO.: 1065 | YTSRLQS |
| J662M2S3#15 VL | CDR-L3 Residues 89-97 of SEQ ID NO.: 1065 | QQGNTQPPT |
| J662M2S3#16 VL | 1066 | DIQMTQSPSSLSASVGDRVTITCRASQDIE NYLNWYQQKPGKAPKLLIYYTSRLQSGVPS RFSGSGSGTDFTLTISSLQPEDFATYFCQQ GNTQPPTFGQGTKLEIK |
| J662M2S3#16 VL | CDR-L1 Residues 24-34 of SEQ ID NO.: 1066 | RASQDIENYLN |
| J662M2S3#16 VL | CDR-L2 Residues 50-56 of SEQ ID NO.: 1066 | YTSRLQS |
| J662M2S3#16 VL | CDR-L3 Residues 89-97 of SEQ ID NO.: 1066 | QQGNTQPPT |
| J662M2S3#21 VL | 1067 | DIQMTQSPSSLSASVGDRVTITCRASQDIS NYLNWYQQKPGKAPKLLIYYTSRLQSGVPS RFSGSGSGTDYTLTISSLQPEDFATYFCQQ GNTWPPTFGQGTKLEIK |
| J662M2S3#21 VL | CDR-L1 Residues 24-34 of SEQ ID NO.: 1067 | RASQDISNYLN |
| J662M2S3#21 VL | CDR-L2 Residues 50-56 of SEQ ID NO.: 1067 | YTSRLQS |
| J662M2S3#21 VL | CDR-L3 Residues 89-97 of SEQ ID NO.: 1067 | QQGNTWPPT |
| J662M2S3#34 VL | 1068 | DIQMTQSPSSLSASVGDRVTITCRASQDIY DVLNWYQQKPGKAPKLLIYYASRLQSGVPS RFSGSGSGTDFTLTISSLQPEDFATYYCQQ GITLPPTFGQGTKLEIK |

TABLE 31-continued

| Individual hMAK-199 clones VL sequences | | |
|---|---|---|
| Protein region | SEQ ID NO: | Sequence 123456789012345678901234567890 |
| J662M2S3#34 CDR-L1 VL | Residues 24-34 of SEQ ID NO.: 1068 | RASQDIYDVLN |
| J662M2S3#34 CDR-L2 4 VL | Residues 50-56 of SEQ ID NO.: 1068 | YASRLQS |
| J662M2S3#34 CDR-L3 VL | Residues 89-97 of SEQ ID NO.: 1068 | QQGITLPPT |
| J662M2S3#36 VL | 1069 | DIQMTQSPSSLSASVGDRVTITCRASQDIS NYLNWYQQKPGKAPKLLIYYTSRLQSGVPS RFSGSGSGTDYTLTISSLQPEDFATYFCQQ GNTWPPTFGQGTKLEIK |
| J662M2S3#36 CDR-L1 VL | Residues 24-34 of SEQ ID NO.: 1069 | RASQDISNYLN |
| J662M2S3#36 CDR-L2 VL | Residues 50-56 of SEQ ID NO.: 1069 | YTSRLQS |
| J662M2S3#36 CDR-L3 VL | Residues 89-97 of SEQ ID NO.: 1069 | QQGNTWPPT |
| J662M2S3#45 VL | 1070 | DIQMTQSPSSLSASVGDRVTITCRASQDIS QYLNWYQQKPGKAPKLLIYYTSRLQSGVPS RFSGSGSGTDFTLTISSLQPEDFATYFCQQ GNTWPPTFGQGTKLEIK |
| J662M2S3#45 CDR-L1 VL | Residues 24-34 of SEQ ID NO.: 1070 | RASQDISQYLN |
| J662M2S3#45 CDR-L2 VL | Residues 50-56 of SEQ ID NO.: 1070 | YTSRLQS |
| J662M2S3#45 CDR-L3 VL | Residues 89-97 of SEQ ID NO.: 1070 | QQGNTWPPT |
| J662M2S3#58 VL | 1071 | DIQMTQSPSSLSASVGDRVTITCRASQNIY NVLNWYQQKPGKAPKLLIYYASRLQSGVPS RFSGSGSGTDFTLTISSLQPEDFATYFCQQ GNTMPPTFGQGTKLEIK |
| J662M2S3#58 CDR-L1 VL | Residues 24-34 of SEQ ID NO.: 1071 | RASQNIYNVLN |
| J662M2S3#58 CDR-L2 VL | Residues 50-56 of SEQ ID NO.: 1071 | YASRLQS |
| J662M2S3#58 CDR-L3 VL | Residues 89-97 of SEQ ID NO.: 1071 | QQGNTMPPT |
| J662M2S3#72 VL | 1072 | DIQMTQSPSSLSASVGDRVTITCRASQDIS NFLNWYQQKPGKAPKLLIYYTSRLQSGVPS RFSGSGSGTDYTLTISSLQPEDFATYFCQQ GNTQPPTFGQGTKLEIK |
| J662M2S3#72 CDR-L1 VL | Residues 24-34 of SEQ ID NO.: 1072 | RASQDISNFLN |
| J662M2S3#72 CDR-L2 VL | Residues 50-56 of SEQ ID NO.: 1072 | YTSRLQS |
| J662M2S3#72 CDR-L3 VL | Residues 89-97 of SEQ ID NO.: 1072 | QQGNTQPPT |

TABLE 32 hMAK199 affinity matured scFv clones converted to full length IgG

| ScFv clone name | HC plasmid | LC plasmid | Full length IgG (protein) name |
|---|---|---|---|
| J662M2S3#10 | pHybE-hCg1,z,non-a V2 J662M2S3#10 | pHybE-hCk V3 J662 M2S3#10 | hMAK199-AM1 |
| J662M2S3#13 | pHybE-hCg1,z,non-a V2 J662M2S3#13 | pHybE-hCk V3 J662 M2S3#13 | hMAK199-AM2 |
| J662M2S3#15 | pHybE-hCg1,z,non-a V2 J662M2S3#15 | pHybE-hCk V3 J662 M2S3#15 | hMAK199-AM3 |
| J662M2S3#16 | pHybE-hCg1,z,non-a V2 J662M2S3#16 | pHybE-hCk V3 J662 M2S3#16 | hMAK199-AM4 |
| J662M2S3#21 | pHybE-hCg1,z,non-a V2 J662M2S3#21 | pHybE-hCk V3 J662 M2S3#21 | hMAK199-AM5 |
| J662M2S3#34 | pHybE-hCg1,z,non-a V2 J662M2S3#34 | pHybE-hCk V3 J662 M2S3#34 | hMAK199-AM6 |
| J662M2S3#36 | pHybE-hCg1,z,non-a V2 J662M2S3#36 | pHybE-hCk V3 J662 M2S3#36 | hMAK199-AM7 |
| J662M2S3#45 | pHybE-hCg1,z,non-a V2 J662M2S3#45 | pHybE-hCk V3 J662 M2S3#45 | hMAK199-AM8 |
| J662M2S3#58 | pHybE-hCg1,z,non-a V2 J662M2S3#58 | pHybE-hCk V3 J662 M2S3#58 | hMAK199-AM9 |
| J662M2S3#72 | pHybE-hCg1,z,non-a V2 J662M2S3#72 | pHybE-hCk V3 J662 M2S3#72 | hMAK199-AM10 |

3.1 TNF Enzyme-Linked Immunosorbent Assay Result

TABLE 33 hMAK199 affinity matured full length IgG

| IgG Name | EC50 in hTNFa ELISA(nM) |
|---|---|
| hMAK199-AM1 | 0.016 |
| hMAK199-AM2 | 0.016 |
| hMAK199-AM3 | 0.019 |
| hMAK199-AM4 | 0.050 |
| hMAK199-AM5 | 0.078 |
| hMAK199-AM6 | 0.035 |
| hMAK199-AM7 | 0.100 |
| hMAK199-AM8 | 0.219 |
| hMAK199-AM9 | 0.032 |
| hMAK199-AM10 | 0.014 |

3.2 TNF Neutralization Potency of TNF Antibodies by L929 Bioassay

TABLE 34

| IgG Name | hu TNF neutralization IC50 (nM) | rhesus TNF neutralization IC50 (nM) |
|---|---|---|
| hMAK199-AM1 | 0.054 | 0.012 |
| hMAK199-AM2 | 0.029 | 0.010 |
| hMAK199-AM3 | 0.051 | 0.019 |
| hMAK199-AM4 | 0.028 | 0.005 |
| hMAK199-AM5 | 0.087 | 0.020 |
| hMAK199-AM6 | 0.033 | 0.004 |
| hMAK199-AM7 | 0.095 | 0.051 |
| hMAK199-AM8 | 0.247 | 0.204 |
| hMAK199-AM9 | 0.163 | 0.089 |
| hMAK199-AM10 | 0.048 | 0.034 |

Example 4

Example 4.4: Affinity Determination Using BIACORE Technology

TABLE 35

| Reagent for Biacore Analyses | | | |
|---|---|---|---|
| Antigen | Vendor Designation | Vendor | Catalog # |
| TNFα | Recombinant Human TNF-α/TNFSF1A | R&D systems | 210-TA |

BIACORE Methods:

The BIACORE assay (Biacore, Inc. Piscataway, N.J.) determines the affinity of binding proteins with kinetic measurements of on-rate and off-rate constants. Binding of binding proteins to a target antigen (for example, a purified recombinant target antigen) is determined by surface plasmon resonance-based measurements with a Biacore® 1000 or 3000 instrument (Biacore® AB, Uppsala, Sweden) using running HBS-EP (10 mM HEPES [pH 7.4], 150 mM NaCl, 3 mM EDTA, and 0.005% surfactant P20) at 25° C. All chemicals are obtained from Biacore® AB (Uppsala, Sweden) or otherwise from a different source as described in the text. For example, approximately 5000 RU of goat anti-mouse IgG, (Fcγ), fragment specific polyclonal antibody (Pierce Biotechnology Inc, Rockford, Ill., US) diluted in 10 mM sodium acetate (pH 4.5) is directly immobilized across a CM5 research grade biosensor chip using a standard amine coupling kit according to manufacturer's instructions and procedures at 25 μg/ml. Unreacted moieties on the biosensor surface are blocked with ethanolamine. Modified carboxymethyl dextran surface in flowcell 2 and 4 is used as a reaction surface. Unmodified carboxymethyl dextran without goat anti-mouse IgG in flow cell 1 and 3 is used as the reference surface. For kinetic analysis, rate equations derived from the 1:1 Langmuir binding model are fitted simultaneously to association and dissociation phases of all eight injections (using global fit analysis) with the use of Biaevaluation 4.0.1 software. Purified antibodies are diluted in HEPES-buffered saline for capture across goat anti-mouse IgG specific reaction surfaces. Antibodies to be captured as a ligand (25

µg/ml) are injected over reaction matrices at a flow rate of 5 µl/minute. The association and dissociation rate constants, $k_{on}$ ($M^{-1}s^{-1}$) and $k_{off}$ ($s^{-1}$), are determined under a continuous flow rate of 25 µl/minute. Rate constants are derived by making kinetic binding measurements at different antigen concentrations ranging from 10-200 nM. The equilibrium dissociation constant (M) of the reaction between antibodies and the target antigen is then calculated from the kinetic rate constants by the following formula: $K_D = k_{off}/k_{on}$. Binding is recorded as a function of time and kinetic rate constants are calculated. In this assay, on-rates as fast as $10^6$ $M^{-1}s^{-1}$ and off-rates as slow as $10^{-6}$ $s^{-1}$ can be measured.

The binding proteins herein are expected to have beneficial properties in this regard, including high affinity, slow off rate, and high neutralizing capacity.

Example 4.5: Neutralization of Human TNF-α

L929 cells are grown to a semi-confluent density and harvested using 0.25% trypsin (Gibco #25300). The cells are washed with PBS, counted and resuspended at 1E6 cells/mL in assay media containing 4 µg/mL actinomycin D. The cells are seeded in a 96-well plate (Costar #3599) at a volume of 100 µL and 5E4 cells/well. The binding proteins and control IgG are diluted to a 4× concentration in assay media and serial 1:4 dilutions are performed. The huTNF-α is diluted to 400 pg/mL in assay media. Binding protein sample (200 µL) is added to the huTNF-α (200 µL) in a 1:2 dilution scheme and allowed to incubate for 0.5 hour at room temperature.

The binding protein/human TNF-α solution is added to the plated cells at 100 µL for a final concentration of 100 pg/mL huTNF-α and 150 nM-0.0001 nM binding protein. The plates are incubated for 20 hours at 37° C., 5% $CO_2$. To quantitate viability, 100 µL is removed from the wells and 10 µL of WST-1 reagent (Roche cat #11644807001) is added. Plates are incubated under assay conditions for 3.5 hours. The plates are read at OD 420-600 nm on a Spectromax 190 ELISA plate reader.

The binding proteins herein are expected to have beneficial properties in this regard, including high affinity, slow off rate, and high neutralizing capacity.

Example 4.6: Treatment

A patient requiring treatment with a TNF-α binding protein may have a disease with immune and inflammatory elements, such as autoimmune diseases, particularly those assocated with inflammation, including Crohn's disease, psoriasis (including plaque psoriasis), arthritis (including rheumatoid arthritis, psoratic arthritis, osteoarthritis, or juvenile idiopathic arthritis), multiple sclerosis, and ankylosing spondylitis. Therefore, the binding proteins herein may be used to treat these disorders.

Administration of the TNF-α binding protein may occur by subcutaneous injection. If the patient has rheumatoid arthritis, psoratic arthritis, or ankylosing spondyitis, the patient may receive 40 mg every other week as a starting dose and 40 mg every week, if necessary to achieve treatment goals. If the patient has juvenile idiopathic arthritis and weighs from 15 kg to <30 kg, the patient may receive 20 mg every other week, and if ≥30 kg, 40 mg every other week. If the patient has Crohn's disease, the patient may receive an initial dose of 160 mg (four 40 mg injections in one day or two 40 mg injections per day for two consecutive days) followed by 80 mg two weeks later, and another two weeks later begin a maintenance dose of 40 mg every other week. If the patient has plaque psoriasis, the patient may receive an 80 mg initial dose, followed by 40 mg every other week starting one week after initial dose.

The binding protein may be provided in a single-use prefilled pen (40 mg/0.8 mL), a single-use prefilled glass syringe (40 mg/0.8 mL or 20 mg/0.4 mL).

INCORPORATION BY REFERENCE

The contents of all cited references (including literature references, patents, patent applications, and websites) that are cited throughout this application are hereby expressly incorporated by reference in their entirety, as are the references cited therein. The practice disclosed herein will employ, unless otherwise indicated, conventional techniques of immunology, molecular biology and cell biology, which are well known in the art.

EQUIVALENTS

The invention may be embodied in other specific forms without departing from the spirit or essential characteristics thereof. The foregoing embodiments are therefore to be considered in all respects illustrative rather than limiting of the invention described herein. Scope of the invention is thus indicated by the appended claims rather than by the foregoing description, and all changes that come within the meaning and range of equivalency of the claims are therefore intended to be embraced herein.

SEQUENCE LISTING (1084 sequences)

SEQ ID NO: 1 - protein, 157 aa, Homo sapiens
VRSSSRTPSDKPVAHVVANPQAEGQLQWLNDRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 2 - protein, 330 aa, Homo sapiens
ASTKGPSVFFLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5 - protein, 105 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 6 - protein, 31 aa, Homo sapiens
QVQLQESGPGLVKPSETLSLTCTVSGGSISS

SEQ ID NO: 7 - protein, 14 aa, Homo sapiens
WIRQPPGKGLEWIG

SEQ ID NO: 8 - protein, 32 aa, Homo sapiens
RVTISVDTSKNQFSLKLSSVTAADTAVYYCAR

SEQ ID NO: 9 - protein, 31 aa, Homo sapiens
EVQLVESGGGLIQPGGSLRLSCAASGFTVSS

SEQ ID NO: 10 - protein, 14 aa, Homo sapiens
WVRQAPGKGLEWVS

SEQ ID NO: 11 - protein, 32 aa, Homo sapiens
RFTISRDNSKNTLYLQMNSLRAEDTAVYYCAR

SEQ ID NO: 12 - protein, 11 aa, Homo sapiens
WGQGTLVTVSS

SEQ ID NO: 13 - protein, 11 aa, Homo sapiens
WGRGTLVTVSS

SEQ ID NO: 14 - protein, 11 aa, Homo sapiens
WGQGTTVTVSS

SEQ ID NO: 15 - protein, 23 aa, Homo sapiens
DIQMTQSPSSLSASVGDRVTITC

SEQ ID NO: 16 - protein, 15 aa, Homo sapiens
WYQQKPGKAPKLLIY

SEQ ID NO: 17 - protein, 32 aa, Homo sapiens
GVPSRFSGSGSGTDFTLTISSLQPEDFATYYC

SEQ ID NO: 18 - protein, 23 aa, Homo sapiens
EIVMTQSPATLSVSPGERATLSC

SEQ ID NO: 19 - protein, 15 aa, Homo sapiens
WYQQKPGQAPRLLIY

SEQ ID NO: 20 - protein, 32 aa, Homo sapiens
GIPARFSGSGSGTEFTLTISSLQSEDFAVYYC

SEQ ID NO: 21 - protein, 11 aa, Homo sapiens
FGQGTKLEIKR

SEQ ID NO: 22 - protein, 117 aa, Homo sapiens
EVQLVQSGAEVKKPGASVKVSCKASGYTFTSYDVNWVRQATGQGLEWMGWMNPNSGNTGYAQKFQGRVTITADESTSTAYMELSSLRSEDTAVYYCAIFDSDYMDVWGKGTLVTVSS

SEQ ID NO: 23 - protein, 108 aa, Homo sapiens
SYELTQPPSVSLSPGQTARITCSGDALPKQYAYWYQQKPGQAPVLVIYKDTERPSGIPERFSGSSSGTTVTLTISGAQAEDEADYYCQSADSSGTSWVFGGGTKLTVL

SEQ ID NO: 24 - protein, 120 aa, Homo sapiens
EVQLVQSGAEVKKPGSSAKVSCKASGGTFSSYAISWVRQAPGQGLEWMGGIIPILGTANYAQKFLGRVTITADESTSTVYMELSSLRSEDTAVYYCARGLYYDPTRADYWGQGTLVTVSS

SEQ ID NO: 25 - protein, 108 aa, Homo sapiens
DIVMTQSPDFHSVTPKEKVTITCRASQSIGSSLHWYQQKPDQSPKLLIRHASQSISGVPSRFSGSGSGTDFTLTIHSLEAEDAATYYCHQSSSSPPPTFGQGTQVEIK

SEQ ID NO: 26 - protein, 126 aa, Homo sapiens
EVQLVESGGGLVQPGGSLRLSCATSGFTFNNYWMSWVRQAPGKGLEWVANINHDESEKYYVDSAKGRFTISRDNAEKSLFLQMNSLRAEDTAVYYCARIIRGRVGFDYYNYAMDVWGQGTLVTVSS

SEQ ID NO: 27 - protein, 105 aa, Homo sapiens
DIRLTQSPSPLSASVGDRVTITCRASQSIGNYLNWYQHKPGKAPKLLIYAASSLQSGVPSRFSGTGSGTDFTLTISSLQPEDFATYYCQESYSLIFAGGTKVEIK

SEQ ID NO: 28 - protein, 124 aa, Homo sapiens
EVQLVQSGAEVKKPGASVKVSCKTSGYTFSNYDINWVRQPTGQGLEWMGWMDPNNGNTGYAQKFVGRVTMTRDTSKTTAYLELSGLKSEDTAVYYCARSSGSGGTWYKEYFQSWGQGTMVTVSS

SEQ ID NO: 29 - protein, 113 aa, Homo sapiens
DIVMTQSPLSLPVTPGEPASISCRSSQSLLHSNGYNYLDWYLQKPGQFPQLLIYLGSYRASGVPDRFSGSGSGTDFTLKISRVEAEDVGVYYCMQRIEFPPGTFGQGTKLGIK

SEQ ID NO: 30 - protein, 115 aa, Homo sapiens
EVQLVQSGAEVKKPGASVKVSCKTSGYSLTQYPIHWVRQAPGQRPEWMGWISPGNGNTKLSPKFQGRVTLSRDASAGTVFMDLSGLTSDDTAVYFCTSVDLGDHWGQGTLVTVSS

SEQ ID NO: 31 - protein, 107 aa, Homo sapiens
DIVMTQSPEFQSVTPKEKVTITCRASQSIGSSLHWYQQKPDQSPKLLINYASQSFSGVPSRFSGGGSGTDFTLTINSLEAEDAATYYCHQSSNLPITFGQGTRLEIK

SEQ ID NO: 32 - protein, 113 aa, Homo sapiens
EVQLVESGGGLVQPGRSLRLSCAASGFTFDDYPMHWVRQAPGEGLEWVSGISSNSASIGYADSVKGRFTISRDNAQNTLYLQMNSLGDEDTAVYYCVSLTLGIGQGTLVTVSS

SEQ ID NO: 33 - protein, 107 aa, Homo sapiens
DIRLTQSPSSLSASVGDRVTITCRASQSIGNYLHWYQQKPGKAPKLLIYAASSLQSGVPSRFSGSGSGTDFTLTISSLQPEDFATYYCQQSYSTLYSFGQGTKLEIK

SEQ ID NO: 34 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIAADGFTDYASSVKGRFTISRDNSKNTLYLQMNSLRAEDTAVYYCAREWHHGPVAYWGQGTLVTVSS

SEQ ID NO: 35 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSLIRGDGSTDYASSLKGRFTISRDNSKNTLYLQMNSLRAEDTAVYYCAREWHHGPVAYWGQGTLVTVSS

SEQ ID NO: 36 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYADTLKSRFTISRDNSKNTLYLQMNSLRAEDTAVYYCAREWQHGPVAYWGQGTLVTVSS

SEQ ID NO: 37 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTDYADTVKGRFTISRDNSKNTLYLQMNSLRAEDTAVYYCAREWQHGPVAYWGQGTLVTVSS

SEQ ID NO: 38 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYADSVKSRFTISRDNSKNTLYLQMNSLRAEDTAVYYCAREWQHGPLAYWGQGTLVTVSS

SEQ ID NO: 39 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWSDGSTDYASSVKGRFTISRDNSKNTLYLQMNSLRAEDTAVYYCAREWQHGPVAYWGQGTLVTVSS

SEQ ID NO: 40 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSLKGRFTISRDNSKNTLYLQMNSLRAEDTAVYYCAREWQHGPAAYWGQGTLVTVSS

SEQ ID NO: 41 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPVAYWGQGTLVTVSS

SEQ ID NO: 42 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPAAYWGQGTLVTVSS

SEQ ID NO: 43 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPSAYWGQGTLVTVSS

SEQ ID NO: 44 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS

SEQ ID NO: 45 - protein, 117 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS

SEQ ID NO: 46 - protein, 117 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVGYWGQGTLVTVSS

SEQ ID NO: 47 - protein, 117 aa, Artificial Sequence; identical to SEQ ID NO: 46
  Description of Artificial Sequence: Synthetic polypeptide

SEQ ID NO: 48 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTDYASTVKGRFTISRDNSKNTLYLQMNSLRAEDTAVYYCAREWQHGPVGYWGQGTLVTVSS

SEQ ID NO: 49 - protein, 117 aa, Artificial Sequence; identical to SEQ ID NO: 44
  Description of Artificial Sequence: Synthetic polypeptide

SEQ ID NO: 50 - protein, 117 aa, Artificial Sequence; identical to SEQ ID NO: 38
  Description of Artificial Sequence: Synthetic polypeptide

SEQ ID NO: 51 - protein, 117 aa, Artificial Sequence
  Description of Artificial Sequence: Synthetic polypeptide
EVQLVESGGGLVQPGGSLRLSCAASGFTFSNYGVQWVRQAPGKGLEWVSGIGADGSTAYASSLKGRFTISRDNSKNTLYLQMNSLRAEDTAVYYCAREWQHSGLAYWGQGTLVTVSS

SEQ ID NO: 52 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYADTVKGRFTISRDNSKNTLYLQMNSLRAEDTAVYYCAREWQHGPLAYWGQGTLVTVSS

SEQ ID NO: 53 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYADTVKGRFTISRDNSKNTLYLQMNSLRAEDTAVYYCAREWQHGPLAYWGQGTLVTVSS

SEQ ID NO: 54 - protein, 117 aa, Artificial Sequence; identical to SEQ ID NO: 44
  Description of Artificial Sequence: Synthetic polypeptide

SEQ ID NO: 55 - protein, 117 aa, Artificial Sequence; identical to SEQ ID NO: 44
  Description of Artificial Sequence: Synthetic polypeptide

SEQ ID NO: 56 - protein, 117 aa, Artificial Sequence; identical to SEQ ID NO: 44
  Description of Artificial Sequence: Synthetic polypeptide

SEQ ID NO: 57 - protein, 117 aa, Artificial Sequence; identical to SEQ ID NO: 44
  Description of Artificial Sequence: Synthetic polypeptide

SEQ ID NO: 58 - protein, 117 aa, Artificial Sequence; identical to SEQ ID NO: 44
  Description of Artificial Sequence: Synthetic polypeptide

SEQ ID NO: 59 - protein, 108 aa, Artificial Sequence
  Description of Artificial Sequence: Synthetic polypeptide
DIQMTQSPSSLSASVGDRVTITCKASQAVSSAVAWYQQKPGKAPKLLIYWASTRHTGVPSRFSGSGSGTDFTLTISSLQPEDFATYYCQQHYSTPFTFGQGTKLEIKR

SEQ ID NO: 60 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 61 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTRHSGVPSRFSGSGSGTDFTLTISSLQPEDFATYYCQQHYRTPFSFGQGTKLEIKR

SEQ ID NO: 62 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTRHSGVPSRFSGSGSGTDFTLTISSLQPEDFATYYCQQHYRTPFTFGQGTKLEIKR

SEQ ID NO: 63 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFSFGQGTKLEIKR

SEQ ID NO: 64 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR

SEQ ID NO: 65 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYRTPFTFGQGTKLEIKR

SEQ ID NO: 66 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTRHTGVPSRFSGSGSGTDFTLTISSLQPEDFATYYCQQHYRTPFTFGQGTKLEIKR

SEQ ID NO: 67 - protein, 108 aa, Artificial Sequence
  Description of Artificial Sequence: Synthetic polypeptide
DIQMTQSPSSLSASVGDRVTITCRASQGVSSALAWYQQKPGKAPKLLIYWASALHSGVPSRFSGSGSGTDFTLTISSLQPEDFATYYCQQHYSAPFTFGQGTKLEIKR

SEQ ID NO: 68 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTLHSGVPSRFSGSGSGTDFTLTISSLQPEDFATYYCQQHYSTPFTFGQGTKLEIKR

SEQ ID NO: 69 - protein, 108 aa, Artificial Sequence
  Description of Artificial Sequence: Synthetic polypeptide
DIQMTQSPSSLSASVGDRVTITCKASQLVSSAVAWYQQKPGKAPKLLIYWASTRHTGVPSRFSGSGSGTDFTLTISSLQPEDFATYYCQQHYSTPFTFGQGTKLEIKR

SEQ ID NO: 70 - protein, 108 aa, Artificial Sequence
  Description of Artificial Sequence: Synthetic polypeptide
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 71 - protein, 108 aa, Artificial Sequence
  Description of Artificial Sequence: Synthetic polypeptide
DIQMTQSPSSLSASVGDRVTITCKASQKVSSALAWYQQKPGKAPKLLIYWASALHSGVPSRFSGSGSGTDFTLTISSLQPEDFATYYCQQHYRPPFTFGQGTKLEIKR

SEQ ID NO: 72 - protein, 108 aa, Artificial Sequence
  Description of Artificial Sequence: Synthetic polypeptide
DIQMTQSPSSLSASVGDRVTITCKASQLVSSAVAWYQQKPGKAPKLLIYWASALHTGVPSRFSGSGSGTDFTLTISSLQPEDFATYYCQQHYSSPYTFGQGTKLEIKR

SEQ ID NO: 73 - protein, 108 aa, Artificial Sequence; identical to SEQ ID NO: 70
  Description of Artificial Sequence: Synthetic polypeptide

SEQ ID NO: 74 - protein, 124 aa, Artificial Sequence
  Description of Artificial Sequence: Synthetic polypeptide
EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS

SEQ ID NO: 75 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGKPTYAQKLQGRVTMTTDTSTSTAYMELSSLRSEDTAVYFCARKLFNTVDVTDNAMDYWGQGTTVTVSS

SEQ ID NO: 76 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGVPTYAQKFQGRVTMTTDTSTSTAYMELSSLRSEDTAVYYCARKLFNTVDVTDNAMDYWGQGTTVTVSS

SEQ ID NO: 77 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSS

SEQ ID NO: 78 - protein, 124 aa, Artificial Sequence
  Description of Artificial Sequence: Synthetic polypeptide
EVQLVQSGAEVKKPGASVKVSCKASGYTFRNYGIIWVRQAPGQGLEWMGWINTYTGKPTYAQKFQGRVTMTTDTSTSTAYMELSSLRSEDTAVYFCARKLFTTVDVTDNAMDYWGQGTTVTVSS

SEQ ID NO: 79 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFRNTVAVTDYAMDYWGQGTTVTVSS

SEQ ID NO: 80 - protein, 124 aa, Artificial Sequence
  Description of Artificial Sequence: Synthetic polypeptide
EVQLVQSGAEVKKPGASVKVSCKASGYTFRNYGITWVRQAPGQGLEWMGWINTYTGKPTYAQKFQGRVTMTTDTSTSTAYMELSSLRSEDTAVYFCARKLFTTMDVTDNAMDYWGQGTTVTVSS

SEQ ID NO: 81 - protein, 124 aa, Artificial Sequence; identical to SEQ ID NO: 74
  Description of Artificial Sequence: Synthetic polypeptide

SEQ ID NO: 82 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGQPSYAQKFQGRVTMTTDTSTSTAYMELSSLRSEDTAVYYCARKLFKTEAVTDYAMDYWGQGTTVTVSS

SEQ ID NO: 83 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYSGKPTYAQKFQGRVTMTTDTSTSTAYMELSSLRSEDTAVYFCARKLFTTMDVTDNAMDYWGQGTTVTVSS

SEQ ID NO: 84 - protein, 107 aa, Artificial Sequence
  Description of Artificial Sequence: Synthetic polypeptide
DIQMTQSPSSLSASVGDRVTITCRASQDISQYLNWYQQKPGKAPKLLIYYTSRLQSGVPSRFSGSGSGTDFTLTISSLQPEDFATYFCQQGNTWPPTFGQGTKLEIK

SEQ ID NO: 85 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNSWPPTFGQGTKLEIK

SEQ ID NO: 86 - protein, 107 aa, Artificial Sequence
  Description of Artificial Sequence: Synthetic polypeptide
DIQMTQSPSSLSASVGDRVTITCRASQDIYNYLNWYQQKPGKAPKLLIYYTSRLQSGVPSRFSGSGSGTDYTLTISSLQPEDFATYFCQQGNTQPPTFGQGTKLEIK

SEQ ID NO: 87 - protein, 107 aa, Artificial Sequence
  Description of Artificial Sequence: Synthetic polypeptide
DIQMTQSPSSLSASVGDRVTITCRASQDIENYLNWYQQKPGKAPKLLIYYTSRLQSGVPSRFSGSGSGTDFTLTISSLQPEDFATYFCQQGNTQPPTFGQGTKLEIK

SEQ ID NO: 88 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTWPPTFGQGTKLEIK

SEQ ID NO: 89 - protein, 107 aa, Artificial Sequence
  Description of Artificial Sequence: Synthetic polypeptide
DIQMTQSPSSLSASVGDRVTITCRASQDIYDVLNWYQQKPGKAPKLLIYYASRLQSGVPSRFSGSGSGTDFTLTISSLQPEDFATYYCQQGITLPPTFGQGTKLEIK

SEQ ID NO: 90 - protein, 107 aa, Artificial Sequence; identical to SEQ ID NO: 88
  Description of Artificial Sequence: Synthetic polypeptide

SEQ ID NO: 91 - protein, 107 aa, Artificial Sequence; identical to SEQ ID NO: 84
  Description of Artificial Sequence: Synthetic polypeptide

SEQ ID NO: 92 - protein, 107 aa, Artificial Sequence
  Description of Artificial Sequence: Synthetic polypeptide
DIQMTQSPSSLSASVGDRVTITCRASQNIYNVLNWYQQKPGKAPKLLIYYASRLQSGVPSRFSGSGSGTDFTLTISSLQPEDFATYFCQQGNTMPPTFGQGTKLEIK

SEQ ID NO: 93 - protein, 107 aa, Artificial Sequence
  Description of Artificial Sequence: Synthetic polypeptide
DIQMTQSPSSLSASVGDRVTITCRASQDISNFLNWYQQKPGKAPKLLIYYTSRLQSGVPSRFSGSGSGTDYTLTISSLQPEDFATYFCQQGNTQPPTFGQGTKLEIK

SEQ ID NO: 94 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSANYAQKFQGRVTITADESTSTAYMELSSLRSEDTAVYYCARGLYYDPTRADYWGQGTLVTVSS

SEQ ID NO: 95 - protein, 120 aa, Artificial Sequence
  Description of Artificial Sequence: Synthetic polypeptide
EVQLVQSGAEVKKPGSSVKVSCKASGGTFSYYSISWVRQAPGQGLEWMGGIMPILGTANYAQKFQGRVTITADESTSTAYMELSSLRSEDTAVYYCARGLYYDPTRADYWGQGTLVTVSS

SEQ ID NO: 96 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIIPILGSPIYAQKFQGRVTITADESTSTAYMELSSLRSEDTAVYYCARGLYYDPTRADYWGQGTLVTVSS

SEQ ID NO: 97 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIIPILGSPIYAQKFQGRVTITADESTSTAYMELSSLRSEDTAVYYCARGLYYDPTRADYWGQGTLVTVSS

SEQ ID NO: 98 - protein, 120 aa, Artificial Sequence
  Description of Artificial Sequence: Synthetic polypeptide
EVQLVQSGAEVKKPGSSVKVSCKASGGTFAWYSISWVRQAPGQGLEWMGGITPILGTANYAQKFQGRVTITADESTSTAYMELSSLRSEDTAVYYCARGLYYDPTRADYWGQGTLVTVSS

SEQ ID NO: 99 - protein, 120 aa, Artificial Sequence
  Description of Artificial Sequence: Synthetic polypeptide
EVQLVQSGAEVKKPGSSVKVSCKASGGTFSFYAISWVRQAPGQGLEWMGGITPILGAATYAQKFQGRVTITADESTSTAYMELSSLRSEDTAVYYCARGLYYDPTRADYWGQGTLVTVSS

SEQ ID NO: 100 - protein, 120 aa, Artificial Sequence
  Description of Artificial Sequence: Synthetic polypeptide
EVQLVQSGAEVKKPGSSVKVSCKASGGTFSIYAISWVRQAPGQGLEWMGGITPILGAAVYAQKFQGRVTITADESTSTAYMELSSLRSEDTAVYYCARGLYYDPTRADYWGQGTLVTVSS

SEQ ID NO: 101 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGTANYAQKFQGRVTITADESTSTAYMELSSLRSEDTAVYYCARGLYYDPTRADYWGQGTLVTVSS

SEQ ID NO: 102 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGVAVYAQKFQGRVTITADESTSTAYMELSSLRSEDTAVYYCARGLYYDPTRADYWGQGTLVTVSS

SEQ ID NO: 103 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGTANYAQKFQGRVTITADESTSTAYMELSSLRSEDTAVYYCARGLYYDPTRADYWGQGTLVTVSS

SEQ ID NO: 104 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSAHYAQKFQGRVTITADESTSTAYMELSSLRSEDTAVYYCARGLYYDPTRADYWGQGTLVTVSS

SEQ ID NO: 105 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSAIYAQKFQGRVTITADESTSTVYMELSSLRSEDTAVYYCARGLYYDPTRADYWGQGTLVTVSS

SEQ ID NO: 106 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGTAIYAQKFQGRVTITADESTSTVYMELSSLRSEDTAVYYCARGLYYDPTRADYWGQGTLVTVSS

SEQ ID NO: 107 - protein, 120 aa, Artificial Sequence
  Description of Artificial Sequence: Synthetic polypeptide
EVQLVQSGAEVKKPGSSVKVSCKASGGTFSIYTISWVRQAPGQGLEWMGGIIPILRNPIYAQKFQGRVTITADESTSTAYMELSSLRSEDTAVYYCARGLYYDPTRADYWGQGTLVTVSS

SEQ ID NO: 108 - protein, 120 aa, Artificial Sequence
  Description of Artificial Sequence: Synthetic polypeptide
EVQLVQSGAEVKKPGSSVKVSCKASGGTFSYYAISWVRQAPGQGLEWMGGIMPILGTPTYAQKFQGRVTITADESTSTAYMELSSLRSEDTAVYYCARGLYYDPTRADYWGQGTLVTVSS

SEQ ID NO: 109 - protein, 120 aa, Artificial Sequence
  Description of Artificial Sequence: Synthetic polypeptide
EVQLVQSGAEVKKPGSSVKVSCKASGGTFSIYTISWVRQAPGQGLEWMGGIIPILGAPIYAQKFQGRVTITADESTSTAYMELSSLRSEDTAVYYCARGLYYDPTRADYWGQGTLVTVSS

SEQ ID NO: 110 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSATYAQKFQGRVTITADESTSTAYMELSSLRSEDTAVYYCARGLYYDPTRADYWGQGTLVTVSS

SEQ ID NO: 111 - protein, 120 aa, Artificial Sequence
  Description of Artificial Sequence: Synthetic polypeptide
EVQLVQSGAEVKKPGSSVKVSCKASGGTFSWYSISWVRQAPGQGLEWMGGIMPILGSASYAQKFQGRVTITADESTSTAYMELSSLRSEDTAVYYCARGLYYDPTRADYWGQGTLVTVSS

SEQ ID NO: 112 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGTASYAQKFQGRVTITADESTSTAYMELSSLRSEDTAVYYCARGLYYDPTRADYWGQGTLVTVSS

SEQ ID NO: 113 - protein, 120 aa, Artificial Sequence
  Description of Artificial Sequence: Synthetic polypeptide
EVQLVQSGAEVKKPGSSVKVSCKASGGTFSWYSISWVRQAPGQGLEWMGGITPILGTANYAQKFQGRVTITADESTSTAYMELSSLRSEDTAVYYCARGLYYDPTRADYWGQGTLVTVSS

SEQ ID NO: 114 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIMPILGTATYAQKFQGRVTITADESTSTAYMELSSLRSEDTAVYYCARGLYYDPTRADYWGQGTLVTVSS

SEQ ID NO: 115 - protein, 120 aa, Artificial Sequence
  Description of Artificial Sequence: Synthetic polypeptide
EVQLVQSGAEVKKPGSSVKVSCKASGGTFSFYTISWVRQAPGQGLEWMGGIMPILGSPHYAQKFQGRVTITADESTSTAYMELSSLRSEDTAVYYCARGLYYDPTRADYWGQGTLVTVSS

SEQ ID NO: 116 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGTANYAQKFQGRVTITADESTSTVYMELSSLRSEDTAVYYCARGLYYDPTRADYWGQGTLVTVSS

SEQ ID NO: 117 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIMPILGSATYAQKFQGRVTITADESTSTAYMELSSLRSEDTAVYYCARGLYYDPTRADYWGQGTLVTVSS

SEQ ID NO: 118 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIIPILGTPTYAQKFQGRVTITADESTSTAYMELSSLRSEDTAVYYCARGLYYDPTRADYWGQGTLVTVSS

SEQ ID NO: 119 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPKRADYWGQGTLVTVSS

SEQ ID NO: 120 - protein, 120 aa, Artificial Sequence
  Description of Artificial Sequence: Synthetic polypeptide
EVQLVQSGAEVKKPGSSVKVSCKASGGTFSLYTISWVRQAPGQGLEWMGGIMPILGAPRYAQKFQGRVTITADESTSTAYMELSSLRSEDTAVYYCARGLYYDPTRADYWGQGTLVTVSS

SEQ ID NO: 121 - protein, 120 aa, Artificial Sequence
  Description of Artificial Sequence: Synthetic polypeptide
EVQLVQSGAEVKKPGSSVKVSCKASGGTFSYYAISWVRQAPGQGLEWMGGIMPILGSPIYAQKFQGRVTITADESTSTVYMELSSLRSEDTAVYYCARGLYYDPTRADYWGQGTLVTVSS

SEQ ID NO: 122 - protein, 120 aa, Artificial Sequence
  Description of Artificial Sequence: Synthetic polypeptide
EVQLVQSGAEVKKPGSSVKVSCKASGGTFSIYAISWVRQAPGQGLEWMGGILPILGSPIYAQKFQGRVTITADESTSTAYMELSSLRSEDTAVYYCARGLYYDPTRADYWGQGTLVTVSS

SEQ ID NO: 123 - protein, 120 aa, Artificial Sequence
  Description of Artificial Sequence: Synthetic polypeptide
EVQLVQSGAEVKKPGSSVKVSCKASGGTFSIYAISWVRQAPGQGLEWMGGIIPILGSPIYAQKFQGRVTITADESTSTAYMELSSLRSEDTAVYYCARGLYYDPTRADYWGQGTLVTVSS

SEQ ID NO: 124 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIVPILGAPLYAQKFQGRVTITADESTSTAYMELSSLRSEDTAVYYCARGLYYDPTRADYWGQGTLVTVSS

SEQ ID NO: 125 - protein, 120 aa, Artificial Sequence
  Description of Artificial Sequence: Synthetic polypeptide
EVQLVQSGAEVKKPGSSVKVSCKASGGTFSIYAISWVRQAPGQGLEWMGGIMPILGAPIYAQKFQGRVTITADESTSTAYMELSSLRSEDTAVYYCARGLYYDPTRADYWGQGTLVTVSS

SEQ ID NO: 126 - protein, 120 aa, Artificial Sequence
  Description of Artificial Sequence: Synthetic polypeptide
EVQLVQSGAEVKKPGSSVKVSCKASGGTFSYYTISWVRQAPGQGLEWMGGIMPILGTPAYAQKFQGRVTITADESTSTAYMELSSLRSEDTAVYYCARGLYYDPTRADYWGQGTLVTVSS

SEQ ID NO: 127 - protein, 120 aa, Artificial Sequence
  Description of Artificial Sequence: Synthetic polypeptide
EVQLVQSGAEVKKPGSSVKVSCKASGGTFSWYSISWVRQAPGQGLEWMGGITPILGAATYAQKFQGRVTITADESTSTAYMELSSLRSEDTAVYYCARGLYYDPTRADYWGQGTLVTVSS

SEQ ID NO: 128 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIIPILGTPTYAQKFQGRVTITADESTSTVYMELSSLRSEDTAVYYCARGLYYDPTRADYWGQGTLVTVSS

SEQ ID NO: 129 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIIPILGTPIYAQKFQGRVTITADESTSTAYMELSSLRSEDTAVYYCARGLYYDPTRADYWGQGTLVTVSS

SEQ ID NO: 130 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGIGNYAQKFQGRVTITADESTSTAYMELSSLRSEDTAVYYCARGLYYDPTRADYWGQGTLVTVSS

SEQ ID NO: 131 - protein, 120 aa, Artificial Sequence
  Description of Artificial Sequence: Synthetic polypeptide
EVQLVQSGAEVKKPGSSVKVSCKASGGTFSIYAISWVRQAPGQGLEWMGGIVPILGAATYAQKFQGRVTITADESTSTAYMELSSLRSEDTAVYYCARGLYYDPTRADYWGQGTLVTVSS

SEQ ID NO: 132 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSSTYAQKFQGRVTITADESTSTAYMELSSLRSEDTAVYYCARGLYYDPTRADYWGQGTLVTVSS

SEQ ID NO: 133 - protein, 120 aa, Artificial Sequence; identical to SEQ ID NO: 101
  Description of Artificial Sequence: Synthetic polypeptide

SEQ ID NO: 134 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGNSIYAQKFQGRVTITADESTSTAYMELSSLRSEDTAVYYCARGLYYDPTRADYWGQGTLVTVSS

SEQ ID NO: 135 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSPIYAQKFQGRVTITADESTSTAYMELSSLRSEDTAVYYCARGLYYDPTRADYWGQGTLVTVSS

SEQ ID NO: 136 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIMPILGTPTYAQKFQGRVTITADESTSTAYMELSSLRSEDTAVYYCARGLYYDPTRADYWGQGTLVTVSS

SEQ ID NO: 137 - protein, 120 aa, Artificial Sequence
  Description of Artificial Sequence: Synthetic polypeptide
EVQLVQSGAEVKKPGSSVKVSCKASGGTFSYYAISWVRQAPGQGLEWMGGITPILGAANYAQKFQGRVTITADESTSTVYMELSSLRSEDTAVYYCARGLYYDPTRADYWGQGTLVTVSS

SEQ ID NO: 138 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAAIYAQKFQGRVTITADESTSTAYMELSSLRSEDTAVYYCARGLYYDPTRADYWGQGTLVTVSS

SEQ ID NO: 139 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGTATYAQKFQGRVTITADESTSTAYMELSSLRSEDTAVYYCARGLYYDPTRADYWGQGTLVTVSS

SEQ ID NO: 140 - protein, 120 aa, Artificial Sequence
  Description of Artificial Sequence: Synthetic polypeptide
EVQLVQSGAEVKKPGSSVKVSCKASGGTFSWYSISWVRQAPGQGLEWMGGITPILGSAHYAQKFQGRVTITADESTSTAYMELSSLRSEDTAVYYCARGLYYDPTRADYWGQGTLVTVSS

SEQ ID NO: 141 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGNAIYAQKFQGRVTITADESTSTAYMELSSLRSEDTAVYYCARGLYYDPTRADYWGQGTLVTVSS

SEQ ID NO: 142 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILRSAVYAQKFQGRVTITADESTSTVYMELSSLRSEDTAVYYCARGLYYDPTRADYWGQGTLVTVSS

SEQ ID NO: 143 - protein, 120 aa, Artificial Sequence
  Description of Artificial Sequence: Synthetic polypeptide
EVQLVQSGAEVKKPGSSVKVSCKASGGTFSWYSISWVRQAPGQGLEWMGGIMPILGTANYAQKFQGRVTITADESTSTAYMELSSLRSEDTAVYYCARGLYYDPTRADYWGQGTLVTVSS

SEQ ID NO: 144 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGTASYAQKFQGRVTITADESTSTAYMELSSLRSEDTAVYYCARGLYYDPTRADYWGQGTLVTVSS

SEQ ID NO: 145 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGTAIYAQKFQGRVTITADESTSTAYMELSSLRSEDTAVYYCARGLYYDPTRADYWGQGTLVTVSS

SEQ ID NO: 146 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSPAYAQKFQGRVTITADESTSTAYMELSSLRSEDTAVYYCARGLYYDPTRADYWGQGTLVTVSS

SEQ ID NO: 147 - protein, 120 aa, Artificial Sequence
  Description of Artificial Sequence: Synthetic polypeptide
EVQLVQSGAEVKKPGSSVKVSCKASGGTFSRYAISWVRQAPGQGLEWMGGIIPILGPASYAQKFQGRVTITADESTSTAYMELSSLRSEDTAVYYCARGLYYDPTRADYWGQGTLVTVSS

SEQ ID NO: 148 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILDAAIYAQKFQGRVTITADESTSTAYMELSSLRSEDTAVYYCARGLYYDPTRADYWGQGTLVTVSS

SEQ ID NO: 149 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGIPNYAQKFQGRVTITADESTSTAYMELSSLRSEDTAVYYCARGLYYDPTRADYWGQGTLVTVSS

SEQ ID NO: 150 - protein, 120 aa, Artificial Sequence
  Description of Artificial Sequence: Synthetic polypeptide
EVQLVQSGAEVKKPGSSVKVSCKASGGTFSIYAISWVRQAPGQGLEWMGGITPILGSAIYAQKFQGRVTITADESTSTAYMELSSLRSEDTAVYYCARGLYYDPTRADYWGQGTLVTVSS

SEQ ID NO: 151 - protein, 120 aa, Artificial Sequence
  Description of Artificial Sequence: Synthetic polypeptide
EVQLVQSGAEVKKPGSSVKVSCKASGGTFSYYAISWVRQAPGQGLEWMGGIMPILGTATYAQKFQGRVTITADESTSTVYMELSSLRSEDTAVYYCARGLYYDPTRADYWGQGTLVTVSS

SEQ ID NO: 152 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDPKRADYWGQGTLVTVSS

SEQ ID NO: 153 - protein, 120 aa, Artificial Sequence
  Description of Artificial Sequence: Synthetic polypeptide
EVQLVQSGAEVKKPGSSVKVSCKASGGTFNWYTISWVRQAPGQGLEWMGGIMPILGTANYAQKFQGRVTITADESTSTAYMELSSLRSEDTAVYYCARGLYYDPTRADYWGQGTLVTVSS

SEQ ID NO: 154 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDFTRADYWGQGTLVTVSS

SEQ ID NO: 155 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIIPILRFPTYAQKFQGRVTITADESTSTVYMELSSLRSEDTAVYYCARGLYYDPTRADYWGQGTLVTVSS

SEQ ID NO: 156 - protein, 120 aa, Artificial Sequence
  Description of Artificial Sequence: Synthetic polypeptide
EVQLVQSGAEVKKPGSSVKVSCKVSGGTFSWYSISWVRQAPGQGLEWMGGILPILDTANYAQKFQGRVTITADESTSTAYMELSSLRSEDTAVYYCARGLYYDPTRADYWGQGTLVTVSS

SEQ ID NO: 157 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIMPILGTAVYAQKFQGRVTITADESTSTAYMELSSLRSEDTAVYYCARGLYYDPTRADYWGQGTLVTVSS

SEQ ID NO: 158 - protein, 120 aa, Artificial Sequence
  Description of Artificial Sequence: Synthetic polypeptide
EVQLVQSGAEVKKPGSSVKVSCKASGGTFSIYSISWVRQAPGQGLEWMGGILPILGTANYAQKFQGRVTITADESTSTVYMELSSLRSEDTAVYYCARGLYYDPTRADYWGQGTLVTVSS

SEQ ID NO: 159 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPTRADYWGQGTLVTVSS

SEQ ID NO: 160 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDPSRADYWGQGTLVTVSS

SEQ ID NO: 161 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFNPTRADYWGQGTLVTVSS

SEQ ID NO: 162 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDPARFDYWGQGTLVTVSS

SEQ ID NO: 163 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYNPSRADYWGQGTLVTVSS

SEQ ID NO: 164 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDPKRADYWGQGTLVTVSS

SEQ ID NO: 165 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDPRRADYWGQGTLVTVSS

SEQ ID NO: 166 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGFYYDPTRADYWGQGTLVTVSS

SEQ ID NO: 167 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDFTRADYWGQGTLVTVSS

SEQ ID NO: 168 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYFDPKRADYWGQGTLVTVSS

SEQ ID NO: 169 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDPTRADYWGQGTLVTVSS

SEQ ID NO: 170 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGIYYDPSRADYWGQGTLVTVSS

SEQ ID NO: 171 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARSLYYERTRADYWGQGTLVTVSS

SEQ ID NO: 172 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARWRFYIPIRFDYWGQGTLVTVSS

SEQ ID NO: 173 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDFTRADYWGQGTLVTVSS

SEQ ID NO: 174 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLFYDPSRADYWGQGTLVTVSS

SEQ ID NO: 175 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPVRADYWGQGTLVTVSS

SEQ ID NO: 176 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPIRADYWGQGTLVTVSS

SEQ ID NO: 177 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGIYYDPKRADYWGQGTLVTVSS

SEQ ID NO: 178 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYNPIRFDYWGQGTLVTVSS

SEQ ID NO: 179 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDPARADYWGQGTLVTVSS

SEQ ID NO: 180 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVFFDPTRADYWGQGTLVTVSS

SEQ ID NO: 181 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVFYNPTRADYWGQGTLVTVSS

SEQ ID NO: 182 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYEGPSADYWGQGTLVTVSS

SEQ ID NO: 183 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYAPNRADYWGQGTLVTVSS

SEQ ID NO: 184 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLFYDPTRADYWGQGTLVTVSS

SEQ ID NO: 185 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYNPTRADYWGQGTLVTVSS

SEQ ID NO: 186 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPARADYWGQGTLVTVSS

SEQ ID NO: 187 - protein, 120 aa, Artificial Sequence
  Description of Artificial Sequence: Synthetic polypeptide
EVQLVQSGAEVKKSGSSVKVSCKASGGTFSSYAISWVRQAPGQGLEWMGGIIPILGTANYAQKFQGRVTITADESTSTVYMELSSLRSEDTAVYYCARGVYYDPGRADYWGQGTLVTVSS

SEQ ID NO: 188 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYFDPSRADYWGQGTLVTVSS

SEQ ID NO: 189 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYFDPSRFDYWGQGTLVTVSS

SEQ ID NO: 190 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYFDFTRADYWGQGTLVTVSS

SEQ ID NO: 191 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGIYYDPTRADYWGQGTLVTVSS

SEQ ID NO: 192 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYFDPSRADYWGQGTLVTVSS

SEQ ID NO: 193 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDPSRFDYWGQGTLVTVSS

SEQ ID NO: 194 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGQYYDTSRADYWGQGTLVTVSS

SEQ ID NO: 195 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARSLYYDTTRFDYWGQGTLVTVSS

SEQ ID NO: 196 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVFYDPTRADYWGQGTLVTVSS

SEQ ID NO: 197 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGIYYDPARADYWGQGTLVTVSS

SEQ ID NO: 198 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLFYDPRRADYWGQGTLVTVSS

SEQ ID NO: 199 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGVYYDTTRADYWGQGTLVTVSS

SEQ ID NO: 200 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDPARADYWGQGTLVTVSS

SEQ ID NO: 201 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCSRGLYYDPTRADYWGQGTLVTVSS

SEQ ID NO: 202 - protein, 120 aa, Artificial Sequence
  Description of Artificial Sequence: Synthetic polypeptide
EVQLVQSGAEVMKPGSSVKVSCKASGGTFSSYAISWVRQAPGQGLEWMGGIIPILGTANYAQKFQGRVTITADESTSTVYMELSSLRSEDTAVYYCTRGLYYDPTRADYWGQGTLVTVSS

SEQ ID NO: 203 - protein, 120 aa, Artificial Sequence
  Description of Artificial Sequence: Synthetic polypeptide
EVQLVQSGAEVKKPGASVKVSCKASGYTFNNYAISWVRQAPGQGLEWMGGIIPILGTANYAQKFQGRVTITADESTSTVYMELSSLRSEDTAVYYCARGLYYDPTRADYWGQGTLVTVSS

SEQ ID NO: 204 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCTRGLYYDPTRADYWGQGTLVTVSS

SEQ ID NO: 205 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCTRGIYYDPTRADYWGQGTLVTVSS

SEQ ID NO: 206 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQEFQGRVTITADESTSTVYMELSSLRSEDTAVYYCARGLYYDPTRADYWGQGTLVTVSS

SEQ ID NO: 207 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCVRGLYYDPTRADYWGQGTLVTVSS

SEQ ID NO: 208 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTASYAQKFQGRVTITADESTSTVYMELSSLRSEDTAVYYCARGLYYDPTRADYWGQGTLVTVSS

SEQ ID NO: 209 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCAKGLYYDPTRADYWGQGTLVTVSS

SEQ ID NO: 210 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCERGLYYDPTRADYWGQGTLVTVSS

SEQ ID NO: 211 - protein, 120 aa, Artificial Sequence
  Description of Artificial Sequence: Synthetic polypeptide
EVQLVQSGAEVKKPGSSVKVSCKASGGTFSNYAISWVRQAPGQGLEWMGGIIPILGTANYAQKFQGRVTITADESTSTVYMELSSLRSEDTAVYYCARGLYYDPTRADYWGQGTLVTVSS

SEQ ID NO: 212 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAHKFQGRVTITADESTSTVYMELSSLRSEDTAVYYCARGLYYDPTRADYWGQGTLVTVSS

SEQ ID NO: 213 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDPTRADCWGQGTLVTVSS

SEQ ID NO: 214 - protein, 120 aa, Artificial Sequence
  Description of Artificial Sequence: Synthetic polypeptide
EVQLVQSGAEVKKPGSSVKVSCKASGGTFSSYAISWVQQAPGQGLEWMGGIIPILGTANYAQKFQGRVTITADESTSTVYMELSSLRSEDTAVYYCARGLYYDPTRADYWGQGTLVTVSS

SEQ ID NO: 215 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGITPILGTANYAQKFQGRVTITADESTSTVYMELSSLRSEDTAVYYCARGLYYDPTRADYWGQGTLVTVSS

SEQ ID NO: 216 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFQGRVTITADESTSTVYMELSSLRSEDTAVYYCARGLYYDPTRADYWGQGTLVTVSS

SEQ ID NO: 217 - protein, 120 aa, Artificial Sequence
  Description of Artificial Sequence: Synthetic polypeptide
EVQLVQSGAEVKKPGSSVKVSCKASGGTFSSYATSWVRQAPGQGLEWMGGIIPILGTANYAQKFQGRVTITADESTSTVYMELSSLRSEDTAVYYCARGLYYDPTRADYWGQGTLVTVSS

SEQ ID NO: 218 - protein, 120 aa, Artificial Sequence
  Description of Artificial Sequence: Synthetic polypeptide
EVQLVQSGAEVKKPGSSVKVSCKASGGTFSSYAISWVRQAPGQGLEWMGGIIPILGTANYAQKFLGRVTITADESTSTVYMELSSLRSEDTAVYYCARGLYYDPTRADYWGQGTLVTVSS

SEQ ID NO: 219 - protein, 120 aa, Artificial Sequence
  Description of Artificial Sequence: Synthetic polypeptide
EVQLVQSGAEVKKPGSSVKVSCKASGGTSSSYAISWVRQAPGQGLEWMGGIIPILGTANYAQKFQGRVTITADESTSTVYMELSSLRSEDTAVYYCARGLYYDPTRADYWGQGTLVTVSS

SEQ ID NO: 220 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSATYAQKFQGRVTITADESTSTVYMELSSLRSEDTAVYYCARGLYYDPKRADYWGQGTLVTVSS

SEQ ID NO: 221 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAASYAQKFQGRVTITADESTSTVYMELSSLRSEDTAVYYCARGIYYDPTRADYWGQGTLVTVSS

SEQ ID NO: 222 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAASYAQKFQGRVTITADESTSTVYMELSSLRSEDTAVYYCARGIYYDPARADYWGQGTLVTVSS

SEQ ID NO: 223 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAANYAQKFQGRVTITADESTSTVYMELSSLRSEDTAVYYCARGVYYDPKRADYWGQGTLVTVSS

SEQ ID NO: 224 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGSPTYAQKFQGRVTITADESTSTVYMELSSLRSEDTAVYYCARGVYYDPRRADYWGQGTLVTVSS

SEQ ID NO: 225 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSATYAQKFQGRVTITADESTSTVYMELSSLRSEDTAVYYCARGIYYDPKRADYWGQGTLVTVSS

SEQ ID NO: 226 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIVPILGTPIYAQKFQGRVTITADESTSTVYMELSSLRSEDTAVYYCARGVYYDPKRADYWGQGTLVTVSS

SEQ ID NO: 227 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSANYAQKFQGRVTITADESTSTVYMELSSLRSEDTAVYYCARGLYYDPARADYWGQGTLVTVSS

SEQ ID NO: 228 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSPTYAQKFQGRVTITADESTSTVYMELSSLRSEDTAVYYCARGVYYDPKRADYWGQGTLVTVSS

SEQ ID NO: 229 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGTPVYAQKFQGRVTITADESTSTVYMELSSLRSEDTAVYYCARGVYYDFRRANYWGQGTLVTVSS

SEQ ID NO: 230 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAATYAQKFQGRVTITADESTSTVYMELSSLRSEDTAVYYCARGIYYDPKRADYWGQGTLVTVSS

SEQ ID NO: 231 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGDPIYAQKFQGRVTITADESTSTVYMELSSLRSEDTAVYYCARGIYYDPKRADYWGQGTLVTVSS

SEQ ID NO: 232 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGNPIYAQKFQGRVTITADESTSTVYMELSSLRSEDTAVYYCARGIYYDYKRADYWGQGTLVTVSS

SEQ ID NO: 233 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSANYAQKFQGRVTITADESTSTVYMELSSLRSEDTAVYYCARGLFYDFRRADYWGQGTLVTVSS

SEQ ID NO: 234 - protein, 120 aa, Artificial Sequence
  Description of Artificial Sequence: Synthetic polypeptide
EVQLVQSGAEVKKPGSSVKVSCKASGGTFAWYAISWVRQAPGQGLEWMGGITPILGNAIYAQKFQGRVTITADESTSTVYMELSSLRSEDTAVYYCARGVYYDPKRADYWGQGTLVTVSS

SEQ ID NO: 235 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGNPIYAQKFQGRVTITADESTSTVYMELSSLRSEDTAVYYCARGVYYDPKRADYWGQGTLVTVSS

SEQ ID NO: 236 - protein, 120 aa, Artificial Sequence
  Description of Artificial Sequence: Synthetic polypeptide
EVQLVQSGAEVKKPGSSVKVSCKASGGTFSWYATSWVRQAPGQGLEWMGGITPILGSPIYAQKFQGRVTITADESTSTVYMELSSLRSEDTAVYYCARGVYYDHRRADYWGQGTLVTVSS

SEQ ID NO: 237 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSPIYAQKFQGRVTITADESTSTVYMELSSLRSEDTAVYYCARGVYYDYKRADYWGQGTLVTVSS

SEQ ID NO: 238 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSAIYAQKFQGRVTITADESTSTVYMELSSLRSEDTAVYYCARGVYYDPKRADYWGQGTLVTVSS

SEQ ID NO: 239 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGTPIYAQKFQGRVTITADESTSTVYMELSSLRSEDTAVYYCARGVYYDFKRADYWGQGTLVTVSS

SEQ ID NO: 240 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGTPIYAQKFQGRVTITADESTSTVYMELSSLRSEDTAVYYCARGVYYDPRRADYWGQGTLVTVSS

SEQ ID NO: 241 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSANYAQKFQGRVTITADESTSTVYMELSSLRSEDTAVYYCARGVYYDPKRADYWGQGTLVTVSS

SEQ ID NO: 242 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAPVYAQKFQGRVTITADESTSTVYMELSSLRSEDTAVYYCARGVYYDPKRADYWGQGTLVTVSS

SEQ ID NO: 243 - protein, 120 aa, Artificial Sequence; identical to SEQ ID NO: 238
  Description of Artificial Sequence: Synthetic polypeptide

SEQ ID NO: 244 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSPIYAQKFQGRVTITADESTSTVYMELSSLRSEDTAVYYCARGIYYDPKRADYWGQGTLVTVSS

SEQ ID NO: 245 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGSANYAQKFQGRVTITADESTSTVYMELSSLRSEDTAVYYCARGIYYDPKRADYWGQGTLVTVSS

SEQ ID NO: 246 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGNAIYAQKFQGRVTITADESTSTVYMELSSLRSEDTAVYYCARGIYYDPKRADYWGQGTLVTVSS

SEQ ID NO: 247 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAATYAQKFQGRVTITADESTSTVYMELSSLRSEDTAVYYCARGVYYDPKRADYWGQGTLVTVSS

SEQ ID NO: 248 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSPIYAQKFQGRVTITADESTSTVYMELSSLRSEDTAVYYCARGIYYDYRRADYWGQGTLVTVSS

SEQ ID NO: 249 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIMPILGIPTYAQKFQGRVTITADESTSTVYMELSSLRSEDTAVYYCARGVYYDPARADYWGQGTLVTVSS

SEQ ID NO: 250 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSPIYAQKFQGRVTITADESTSTVYMELSSLRSEDTAVYYCARGVYYDPKRADYWGQGTLVTVSS

SEQ ID NO: 251 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSAVYAQKFQGRVTITADESTSTVYMELSSLRSEDTAVYYCARGVYYDPKRADYWGQGTLVTVSS

SEQ ID NO: 252 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSAIYAQKFQGRVTITADESTSTVYMELSSLRSEDTAVYYCARGIYYDYKRADYWGQGTLVTVSS

SEQ ID NO: 253 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGYPIYAQKFQGRVTITADESTSTVYMELSSLRSEDTAVYYCARGVYYDPKRADYWGQGTLVTVSS

SEQ ID NO: 254 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAATYAQKFQGRVTITADESTSTVYMELSSLRSEDTAVYYCARGIYYDFRRADYWGQGTLVTVSS

SEQ ID NO: 255 - protein, 120 aa, Artificial Sequence
  Description of Artificial Sequence: Synthetic polypeptide
EVQLVQSGAEVKKPGSSVKVSCKASGGTFSWYPISWVRQAPGQGLEWMGGITPILGSAIYAQKFQGRVTITADESTSTVYMELSSLRSEDTAVYYCARGVYYDFRRADYWGQGTLVTVSS

SEQ ID NO: 256 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGTANYAQKFQGRVTITADESTSTVYMELSSLRSEDTAVYYCARGVYYDPKRADYWGQGTLVTVSS

SEQ ID NO: 257 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGSAVYAQKFQGRVTITADESTSTVYMELSSLRSEDTAVYYCARGIYYDPKRADYWGQGTLVTVSS

SEQ ID NO: 258 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGNPIYAQKFQGRVTITADESTSTVYMELSSLRSEDTAVYYCARGVYYDPARADYWGQGTLVTVSS

SEQ ID NO: 259 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGAPNYAQKFQGRVTITADESTSTVYMELSSLRSEDTAVYYCARGVYYDYTRADYWGQGTLVTVSS

SEQ ID NO: 260 - protein, 120 aa, Artificial Sequence
  Description of Artificial Sequence: Synthetic polypeptide
EVQLVQSGAEVKKPGSSVKVSCKASGGTFAWYAISWVRQAPGQGLEWMGGITPILGSPTYAQKFQGRVTITADESTSTVYMELSSLRSEDTAVYYCARGVYYDPKRADYWGQGTLVTVSS

SEQ ID NO: 261 - protein, 120 aa, Artificial Sequence
  Description of Artificial Sequence: Synthetic polypeptide
EVQLVQSGAEVKKPGSSVKVSCKASGGTFGWYATSWVRQAPGQGLEWMGGIIPILGTPNYAQKFQGRVTITADESTSTVYMELSSLRSEDTAVYYCARGVYYDPKRADYWGQGTLVTVSS

SEQ ID NO: 262 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGTPTYAQKFQGRVTITADESTSTVYMELSSLRSEDTAVYYCARGVYYDPKRADYWGQGTLVTVSS

SEQ ID NO: 263 - protein, 120 aa, Artificial Sequence
  Description of Artificial Sequence: Synthetic polypeptide
EVQLVQSGAEVKKPGSSVKVSCKASGGTFSWYTISWVRQAPGQGLEWMGGIMPILGSPNYAQKFQGRVTITADESTSTVYMELSSLRSEDTAVYYCARGIYYDPKRADYWGQGTLVTVSS

SEQ ID NO: 264 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGIMPILGSATYAQKFQGRVTITADESTSTVYMELSSLRSEDTAVYYCARGVYFDPKRADYWGQGTLVTVSS

SEQ ID NO: 265 - protein, 120 aa, Artificial Sequence
  Description of Artificial Sequence: Synthetic polypeptide
EVQLVQSGAEVKKPGSSVKVSCKASGGTFSWYAISWVRQAPGQGLEWMGGITPILGAANYAQKFQGRVTITADESTSTVYMELSSLRSEDTAVYYCARGLYYDPKRADYWGQGTLVTVSS

SEQ ID NO: 266 - protein, 120 aa, Artificial Sequence
  Description of Artificial Sequence: Synthetic polypeptide
EVQLVQSGAEVKKPGSSVKVSCKASGGTFSWYPISWVRQAPGQGLEWMGGITPILGAGIYAQKFQGRVTITADESTSTVYMELSSLRSEDTAVYYCARGVYYDFKRADYWGQGTLVTVSS

SEQ ID NO: 267 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQSSSSPPPTFGQGTKVEIK

SEQ ID NO: 268 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQSSSSPPPTFGQWTKVEIK

SEQ ID NO: 269 - protein, 108 aa, Artificial Sequence
  Description of Artificial Sequence: Synthetic polypeptide
EIVLTQSPDFQSVTPKEKVTITCRARQSIGSSLHWYQQKPDQSPKLLIKHASQSISGVPSRFSGSGSGTNFTLTINSLEAEDAATYYCHQSSSSPPPTFGQGTKVEIK

SEQ ID NO: 270 - protein, 108 aa, Artificial Sequence; identical to SEQ ID NO: 267
  Description of Artificial Sequence: Synthetic polypeptide

SEQ ID NO: 271 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKHASQSVSGVPSRFSGSGSGTDFTLTINSLEAEDAATYYCHQNRSSPPSTFGQGTKVEIK

SEQ ID NO: 272 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKYASQSLSGVPSRFSGSGSGTDFTLTINSLEAEDAATYYCHQSSSSPPVTFGQGTKVEIK

SEQ ID NO: 273 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAATYYCHQRSNLPAPTFGQGTKVEIK

SEQ ID NO: 274 - protein, 108 aa, Artificial Sequence
  Description of Artificial Sequence: Synthetic polypeptide
EIVLTQSPDFQSVTPKEKVTITCRASQIIGGSLHWYQQKPDQSPKLLIKYASQSFSGVPSRFSGSGSGTDFTLTINSLEAEDAATYYCHQPICSPPRTFGQGTKVEIK

SEQ ID NO: 275 - protein, 108 aa, Artificial Sequence
  Description of Artificial Sequence: Synthetic polypeptide
EIVLTQSPDFQSVTPKEKVTITCRASQTIGSNLHWYQQKPDQSPKLLIKYASQSLSGVPSRFSGSGSGTDFTLTINSLEAEDAATYYCHQCSISPPATFGQGTKVEIK

SEQ ID NO: 276 - protein, 108 aa, Artificial Sequence
  Description of Artificial Sequence: Synthetic polypeptide
EIVLTQSPDFQSVTPKEKVTITCRASQCIGTSLHWYQQKPDQSPKLLIKYDSQSISGVPSRFSGSGSGTDFTLTINSLEAEDAATYYCHQNSSSPPPTFGQGTKVEIK

SEQ ID NO: 277 - protein, 108 aa, Artificial Sequence
  Description of Artificial Sequence: Synthetic polypeptide
EIVLTQSPDFQSVTPKEKVTITCRASQNIGNSLHWYQQKPDQSPKLLIKYTSQSISGVPSRFSGSGSGTDFTLTINSLEAEDAATYYCHQTSSLPLPTFGQGTKVEIK

SEQ ID NO: 278 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYVSQSISGVPSRFSGSGSGTDFTLTINSLEAEDAATYYCHQISDLPTSTFGQGTKVEIK

SEQ ID NO: 279 - protein, 108 aa, Artificial Sequence
  Description of Artificial Sequence: Synthetic polypeptide
EIVLTQSPDFQSVTPKEKVTITCRASQRIGSNLHWYQQKPDQSPKLLIKYASQSISGVPSRFSGSGSGTDFTLTINSLEAEDAATYYCHQGSSLPPPTFGQGTKVEIK

SEQ ID NO: 280 - protein, 108 aa, Artificial Sequence
  Description of Artificial Sequence: Synthetic polypeptide
EIVLTQSPDFQSVTPKEKVTITCRASQCIGSSLHWYQQKPDQSPKLLIKHTSQSNSGVPSRFSGSGSGTDFTLTINSLEAEDAATYYCHQSNSSPLSTFGQGTKVEIK

SEQ ID NO: 281 - protein, 108 aa, Artificial Sequence
  Description of Artificial Sequence: Synthetic polypeptide
EIVLTQSPDFQSVTPKEKVTITCRASQNIGGSLHWYQQKPDQSPKLLIKYASQSISGVPSRFSGSGSGTDFTLTINSLEAEDAATYYCHQNSSLPLPTFGQGTKVEIK

SEQ ID NO: 282 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKYASQSISGVPSRFSGSGSGTDFTLTINSLEAEDAATYYCHQSSKSPPPTFGQGTKVEIK

SEQ ID NO: 283 - protein, 108 aa, Artificial Sequence
  Description of Artificial Sequence: Synthetic polypeptide
EIVLTQSPDFQSVTPKEKVTITCRASQSIGSCLHWYQQKPDQSPKLLIKYASQSVSGVPSRFSGSGSGTDFTLTINSLEAEDAATYYCHQRSSLPTPTFGQGTKVEIK

SEQ ID NO: 284 - protein, 108 aa, Artificial Sequence
  Description of Artificial Sequence: Synthetic polypeptide
EIVLTQSPDFQSVTPKEKVTITCRASQSIGGRLHWYQQKPDQSPKLLIKYASQSLSGVPSRFSGSGSGTDFTLTINSLEAEDAATYYCHQASSSPSTTFGQGTKVEIK

SEQ ID NO: 285 - protein, 108 aa, Artificial Sequence
  Description of Artificial Sequence: Synthetic polypeptide
EIVLTQSPDFQSVTPKEKVTITCRASQRIGPSLHWYQQKPDQSPKLLIKYASQSISGVPSRFSGSGSGTDFTLTINSLEAEDAATYYCHQNSCLPSTTFGQGTKVEIK

SEQ ID NO: 286 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKYASQSRSGVPSRFSGSGSGTDFTLTINSLEAEDAATYYCHQSGISPPTTFGQGTKVEIK

SEQ ID NO: 287 - protein, 108 aa, Artificial Sequence
  Description of Artificial Sequence: Synthetic polypeptide
EIVLTQSPDFQSVTPKEKVTITCRASQSIGTSLHWYQQKPDQSPKLLIKYVSQSISGVPSRFSGSGSGTDFTLTINSLEAEDAATYYCHQGMSSPAPTFGQGTKVEIK

SEQ ID NO: 288 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSLSGVPSRFSGSGSGTDFTLTINSLEAEDAATYYCHQRRNSPPPTFGQGTKVEIK

SEQ ID NO: 289 - protein, 108 aa, Artificial Sequence
  Description of Artificial Sequence: Synthetic polypeptide
EIVLTQSPDFQSVTPKEKVTITCRASQKIGSGLHWYQQKPDQSPKLLIKHASQSISGVPSRFSGSGSGTDFTLTINSLEAEDAATYYCHQNNSSPHKTFGQGTKVEIK

SEQ ID NO: 290 - protein, 108 aa, Artificial Sequence
  Description of Artificial Sequence: Synthetic polypeptide
EIVLTQSPDFQSVTPKEKVTITCRASQTIGSNLHWYQQKPDQSPKLLIKHSSQSISGVPSRFSGSGSGTDFTLTINSLEAEDAATYYCHQNSSSPLPTFGQGTKVEIK

SEQ ID NO: 291 - protein, 108 aa, Artificial Sequence
  Description of Artificial Sequence: Synthetic polypeptide
EIVLTQSPDFQSVTPKEKVTITCRASQNIGRSLHWYQQKPDQSPKLLIKYASQSSSGVPSRFSGSGSGTDFTLTINSLEAEDAATYYCHQSRSSPPPTFGQGTKVEIK

SEQ ID NO: 292 - protein, 108 aa, Artificial Sequence
  Description of Artificial Sequence: Synthetic polypeptide
EIVLTQSPDFQSVTPKEKVTITCRASQCIGKSLHWYQQKPDQSPKLLIKHPSQSVSGVPSRFSGSGSGTDFTLTINSLEAEDAATYYCHQSIGLPPTTFGQGTKVEIK

SEQ ID NO: 293 - protein, 108 aa, Artificial Sequence
  Description of Artificial Sequence: Synthetic polypeptide
EIVLTQSPDFQSVTPKEKVTITCRASQTIGSSLHWYQQKPDQSPKLLIKHASQSLSGVPSRFSGSGSGTDFTLTINSLEAEDAATYYCHQSSISPPATFGQGTKVEIK

SEQ ID NO: 294 - protein, 108 aa, Artificial Sequence
  Description of Artificial Sequence: Synthetic polypeptide
EIVLTQSPDFQSVTPKEKVTITCRASQSIGSTLHWYQQKPDQSPKLLIKYESQSISGVPSRFSGSGSGTDFTLTINSLEAEDAATYYCHQRCCSPTQTFGQGTKVEIK

SEQ ID NO: 295 - protein, 108 aa, Artificial Sequence
  Description of Artificial Sequence: Synthetic polypeptide
EIVLTQSPDFQSVTPKEKVTITCRASQSIGRKLHWYQQKPDQSPKLLIKYSSQSISGVPSRFSGSGSGTDFTLTINSLEAEDAATYYCHQSSRSPPTTFGQGTKVEIK

SEQ ID NO: 296 - protein, 108 aa, Artificial Sequence
  Description of Artificial Sequence: Synthetic polypeptide
EIVLTQSPDFQSVTPKEKVTITCRASQTIGTSLHWYQQKPDQSPKLLIKHASQSLSGVPSRFSGSGSGTDFTLTINSLEAEDAATYYCHQSSSSPSPTFGQGTKVEIK

SEQ ID NO: 297 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHVSQSISGVPSRFSGSGSGTDFTLTINSLEAEDAATYYCHQRGSSPPRTFGQGTKVEIK

SEQ ID NO: 298 - protein, 108 aa, Artificial Sequence
  Description of Artificial Sequence: Synthetic polypeptide
EIVLTQSPDFQSVTPKEKVTITCRASQTIGSTLHWYQQKPDQSPKLLIKHTSQSISGVPSRFSGSGSGTDFTLTINSLEAEDAATYYCHQRSSSPPPTFGQGTKVEIK

SEQ ID NO: 299 - protein, 108 aa, Artificial Sequence
  Description of Artificial Sequence: Synthetic polypeptide
EIVLTQSPDFQSVTPKEKVTITCRASQSIGSNLHWYQQKPDQSPKLLIKHGSQSISGVPSRFSGSGSGTDFTLTINSLEAEDAATYYCHQRHSSPRATFGQGTKVEIK

SEQ ID NO: 300 - protein, 108 aa, Artificial Sequence
  Description of Artificial Sequence: Synthetic polypeptide
EIVLTQSPDFQSVTPKEKVTITCRASQKIGSNLHWYQQKPDQSPKLLIKYASQSFSGVPSRFSGSGSGTDFTLTINSLEAEDAATYYCHQNSSSPPATFGQGTKVEIK

SEQ ID NO: 301 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKYASQSISGVPSRFSGSGSGTDFTLTINSLEAEDAATYYCHQSSRSPFRTFGQGTKVEIK

SEQ ID NO: 302 - protein, 108 aa, Artificial Sequence
  Description of Artificial Sequence: Synthetic polypeptide
EIVLTQSPDFQSVTPKEKVTITCRASQCIGRRLHWYQQKPDQSPKLLIKHASQSRSGVPSRFSGSGSGTDFTLTINSLEAEDAATYYCHQCTSSPPPTFGQGTKVEIK

SEQ ID NO: 303 - protein, 108 aa, Artificial Sequence
  Description of Artificial Sequence: Synthetic polypeptide
EIVLTQSPDFQSVTPKEKVTITCRASQRIGSNLHWYQQKPDQSPKLLIKHASQSISGVPSRFSGSGSGTDFTLTINSLEAEDAATYYCHQSLRLPPQTFGQGTKVEIK

SEQ ID NO: 304 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQNRSLPRLTFGQGTKVEIK

SEQ ID NO: 305 - protein, 108 aa, Artificial Sequence
  Description of Artificial Sequence: Synthetic polypeptide
EIVLTQSPDFQSVTPKEKVTITCRASQSIGSCLHWYQQKPDQSPKLLIKYASQSISGVPSSSVASGSGTDFTLTINSLEAEDAATYYCHQRSSLPQPTFGQGTKVEIK

SEQ ID NO: 306 - protein, 108 aa, Artificial Sequence
  Description of Artificial Sequence: Synthetic polypeptide
EIVLTQSPDFQSVTPKEKVTITCRASQSIGRRLHWYQQKPDQSPKLLIKHPSQSVSGVPSRFSGSGSGTDFTLTINSLEAEDAATYYCHQSIDSPPPTFGQGTKVEIK

SEQ ID NO: 307 - protein, 108 aa, Artificial Sequence
  Description of Artificial Sequence: Synthetic polypeptide
EIVLTQSPDFQSVTPKEKVTITCRASQTIGRSLHWYQQKPDQSPKLLIKYKSQSSSGVPSRFSGSGSGTDFTLTINSLEAEDAATYYCHQRWGLPMPTFGQGTKVEIK

SEQ ID NO: 308 - protein, 108 aa, Artificial Sequence
  Description of Artificial Sequence: Synthetic polypeptide
EIVLTQSPDFQSVTPKEKVTITCRASQRIGSMLHWYQQKPDQSPKLLIKHSSQSISGVPSRFSGSGSGTDFTLTINSLEAEDAATYYCHQTNSLPPRTFGQGTKVEIK

SEQ ID NO: 309 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKHASQSISGVPSRFSGSGSGTDFTLTINSLEAEDAATYYCHQGSRSPLDTFGQGTKVEIK

SEQ ID NO: 310 - protein, 108 aa, Artificial Sequence
  Description of Artificial Sequence: Synthetic polypeptide
EIVLTQSPDFQSVTPKEKVTITCRASQSIGCSLHWYQQKPDQSPKLLIKYASQSVSVVPSRFSGSGSGTDFTLTINSLEAEDAATYYCHQSSTLPPPTFGQGTKVEIK

SEQ ID NO: 311 - protein, 108 aa, Artificial Sequence
  Description of Artificial Sequence: Synthetic polypeptide
EIVLTQSPDFQSVTPKEKVTITCRASQGIGTSLHWYQQKPDQSPKLLIKHDSQSISGVPSRFSGSGSGTDFTLTINSLEAEDAATYYCHQTSSLPPPTFGQGTKVEIK

SEQ ID NO: 312 - protein, 108 aa, Artificial Sequence
  Description of Artificial Sequence: Synthetic polypeptide
EIVLTQSPDFQSVTPKEKVTITCRASQIIGSSLHWYQQKPDQSPKLLIKHASQSISGVPSRFSGSGSGTDFTLTINSLEAEDAATYYCHQSSSLPLPTFGQGTKVEIK

SEQ ID NO: 313 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYTSQSKSGVPSRFSGSGSGTDFTLTINSLEAEDAATYYCHQGNRSPSTTFGQGTKVEIK

SEQ ID NO: 314 - protein, 108 aa, Artificial Sequence
  Description of Artificial Sequence: Synthetic polypeptide
EIVLTQSPDFQSVTPKEKVTITCRASKRIGSSLHWYQQKPDQSPKLLIKHKSQSISGVPSRFSGSGSGTDFTLTINSLEAEDAATYYCHQRSASPPPTFGQGTKVEIK

SEQ ID NO: 315 - protein, 108 aa, Artificial Sequence
  Description of Artificial Sequence: Synthetic polypeptide
EIVLTQSPDFQSVTPKEKVTITCRASQTIGSSLHWYQQKPDQSPKLLIKHPSQSMSGVPSRFSGSGSGTDFTLTINSLEAEDAATYYCHQSSTSPPATFGQGTKVEIK

SEQ ID NO: 316 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQRSSLPTPTFGQGTKVEIK

SEQ ID NO: 317 - protein, 108 aa, Artificial Sequence
  Description of Artificial Sequence: Synthetic polypeptide
EIVLTQSPDFQSVTPKEKVTITCRASQSIGSTLHWYQQKPDQSPKLLIKHASQSFSGVPSRFSGSGSGTDFTLTINSLEAEDAATYYCHQSNCSPAHTFGQGTKVEIK

SEQ ID NO: 318 - protein, 108 aa, Artificial Sequence
  Description of Artificial Sequence: Synthetic polypeptide
EIVLTQSPDFQSVTPKEKVTITCRASQTIGSRLHWYQQKPDQSPKLLIKYVSQSISGVPSRFSGSGSGTDFTLTINSLEAEDAATYYCHQGSRLPPPTFGQGTKVEIK

SEQ ID NO: 319 - protein, 108 aa, Artificial Sequence
  Description of Artificial Sequence: Synthetic polypeptide
EIVLTQSPDFQSVTPKEKVTITCRASQRIGSTLHWYQQKPDQSPKLLIKHASQSNSGVPSRFSGSGSGTDFTLTINSLEAEDAATYYCHQSSCSPQATFGQGTKVEIK

SEQ ID NO: 320 - protein, 108 aa, Artificial Sequence
  Description of Artificial Sequence: Synthetic polypeptide
EIVLTQSPDFQSVTPKEKVTITCRASQSIGTSLHWYQQKPDQSPKLLIKYPSQSISGVPSRFSGSGSGTDFTLTINSLEAEDAATYYCHQSGRSPPHTFGQGTKVEIK

SEQ ID NO: 321 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQNSILPPPTFGQGTKVEIK

SEQ ID NO: 322 - protein, 108 aa, Artificial Sequence
  Description of Artificial Sequence: Synthetic polypeptide
EIVLTQSPDFQSVTPKEKVTITCRASQCIGSYLHWYQQKPDQSPKLLIKHVSQSISGVPSRFSGSGSGTDFTLTINSLEAEDAATYYCHQSSSSPTLTFGQGTKVEIK

SEQ ID NO: 323 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSMSGVPSGFSGSGSGTDFTLTINSLEAEDAATYYCHQTNRSPPPTFGQGTKVEIK

SEQ ID NO: 324 - protein, 108 aa, Artificial Sequence
  Description of Artificial Sequence: Synthetic polypeptide
EIVLTQSPDFQSVTPKEKVTITCRASQNIGTSLHWYQQKPDQSPKLLIKYVSQSISGVPSRFSGSGSGTDFTLNINSLEAEDAATYYCHQSSCLPRPTFGQGTKVEIK

SEQ ID NO: 325 - protein, 108 aa, Artificial Sequence
  Description of Artificial Sequence: Synthetic polypeptide
EIVLTQSPDFQSVTPKEKVTITCRASQSIGSPLHWYQQKPDQSPKLLIKYASQSISGVPSRFSGSGSGTDFTLTINSLEAEDAATYYCHQGSSSPPPTFGQGTKVEIK

SEQ ID NO: 326 - protein, 108 aa, Artificial Sequence
  Description of Artificial Sequence: Synthetic polypeptide
EIVLTQSPDFQSVTPKEKVTITCRASQSIGSTLHWYQQKPDQSPKLLIKHDSQSKSGVPSRFSGSGSGTDFTLTINSLEAEDAATYYCHQSSDSPAPTFGQGTKVEIK

SEQ ID NO: 327 - protein, 108 aa, Artificial Sequence
  Description of Artificial Sequence: Synthetic polypeptide
EIVLTQSPDFQSVTPKEKVTITCRASQSIGSCLHWYQQKPDQSPKLLIKHASQSNSGVPSRFSGSGSGTDFTLTINSLEAEDAATYYCHQSRISPLPTFGQGTKVEIK

SEQ ID NO: 328 - protein, 108 aa, Artificial Sequence
  Description of Artificial Sequence: Synthetic polypeptide
EIVLTQSPDFQSVTPKEKVTITCRASQSIGRRLHWYQQKPDQSPKLLIKHSSQSISGVPSRFSGSGSGTDFTLTINSLEAEDAATYYCHQCSSLPHPTFGQGTKVEIK

SEQ ID NO: 329 - protein, 108 aa, Artificial Sequence
  Description of Artificial Sequence: Synthetic polypeptide
EIVLTQSPDFQSVTPKEKVTITCRASQRIGSRLHWYQQKPDQSPKLLIKHASQSTSGVPSRFSGSGSGTDFTLTINSLEAEDAATYYCHQSCSSPLVTFGQGTKVEIK

SEQ ID NO: 330 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKHASQSSSGVPSRFSGSGSGTDFTLTINSLEAEDAATYYCHQSGSSPQATFGQGTKVEIK

SEQ ID NO: 331 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSVSGVPSRFSGSGSGTDFTLTINSLEAEDAATYYCHQNRGSPPQTFGQGTKVEIK

SEQ ID NO: 332 - protein, 108 aa, Artificial Sequence
  Description of Artificial Sequence: Synthetic polypeptide
EIVLTQSPDFQSVTPKEKVTITCRASQTIGSILHWYQQKPDQSPKLLIKHASQSISGVPSRFSGSGSGTDFTLTINSLEAEDAATYYCHQNTSLPPPTFGQGTKVEIK

SEQ ID NO: 333 - protein, 108 aa, Artificial Sequence
  Description of Artificial Sequence: Synthetic polypeptide
EIVLTQSPDFQSVTPKEKVTITCRASQSIGNSLHWYQQKPDQSPKLLIKYPSQSISGVPSRFSGSGSGTDFTLTINSLEAEDAATYYCHQGSRLPVPTFGQGTKVEIK

SEQ ID NO: 334 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKHTSQSNSGVPSRFSGSGSGTDFTLTINSLEAEDAATYYCHQSSSLPAPTFGQGTKVEIK

SEQ ID NO: 335 - protein, 108 aa, Artificial Sequence
  Description of Artificial Sequence: Synthetic polypeptide
EIVLTQSPDFQSVTPKEKVTITCRASQNIGSSLHWYQQKPDQSPKLLIKHVSQSISGVPSRFSGSGSGTDFTLTINSLEAEDAATYYCHQSNSLPAPTFGQGTKVEIK

SEQ ID NO: 336 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQSMSLPSATFGQGTKVEIK

SEQ ID NO: 337 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHLSQSISGVPSRFSGSGSGTDFTLTINSLEAEDAATYYCHQPCRLPPSTFGQGTKVEIK

SEQ ID NO: 338 - protein, 108 aa, Artificial Sequence
  Description of Artificial Sequence: Synthetic polypeptide
EIVLTQSPDFQSVTPKEKVTITCRASQSIGSLLHWYQQKPDQSPKLLIKHASQSISGVPSRFSGSGSGTDFTLTINSLEAEDAATYYCHQSCSSPRHTFGQGTKVEIK

SEQ ID NO: 339 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHPSQSKSGVPSRFSGSGSGTDFTLTINSLEAEDAATYYCHQSSRSPAPTFGQGTKVEIK

SEQ ID NO: 340 - protein, 108 aa, Artificial Sequence
  Description of Artificial Sequence: Synthetic polypeptide
EIVLTQSPDFQSVTPKEKVTITCRASQSIGGSLHWYQQKPDQSPKLLIKYSSQSLSGVPSRFSGSGSGTDFTLTINSLEAEDAATYYCHQSSILPSLTFGQGTKVEIK

SEQ ID NO: 341 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHPSQSISGVPSRFSGSGSGTDFTLTINSLEAEDAATYYCHQSRNLPPRTFGQGTKVEIK

SEQ ID NO: 342 - protein, 108 aa, Artificial Sequence
  Description of Artificial Sequence: Synthetic polypeptide
EIVLTQSPDFQSVTPKEKVTITCRASQSIGSILHWYQQKPDQSPKLLIKYGSQSLSGVPSRFSGSGSGTDFTLTINSLEAEDAATYYCHQNGSSPPRTFGQGTKVEIK

SEQ ID NO: 343 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYFSQSISGVPSRFSGSGSGTDFTLTINSLEAEDAATYYCHQNSCLPMQTFGQGTKVEIK

SEQ ID NO: 344 - protein, 108 aa, Artificial Sequence
  Description of Artificial Sequence: Synthetic polypeptide
EIVLTQSPDFQSVTPKEKVTITCRASQNIGSSLHWYQQKPDQSPKLLIKYSSQSVSGVPSRFSGSGSGTDFTLTINSLEAEDAATYYCHQSSISPPATFGQGTKVEIK

SEQ ID NO: 345 - protein, 108 aa, Artificial Sequence
  Description of Artificial Sequence: Synthetic polypeptide
EIVLTQSPDFQSVTPKEKVTITCRASQCIGSSLHWYQQKPDQSPKLLIKHASQSNSGVPSRFSGSGSGTDFTLTINSLEAEDAATYYCHQSTCLPPRTFGQGTKVEIK

SEQ ID NO: 346 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKYVSQSMSGVLSRFSGSGSGTDFTLTINSLEAEDAATYYCHQPSTSPRPTFGQGTKVEIK

SEQ ID NO: 347 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKHASQSISGVPSRFSGSGSGTDFTLTINSLEAEDAATYYCHQNSSLPPSTFGQGTKVEIK

SEQ ID NO: 348 - protein, 108 aa, Artificial Sequence
  Description of Artificial Sequence: Synthetic polypeptide
EIVLTQSPDFQSVTPKEKVTITCRASQSIGCSLHWYQQKPDQSPKLLIKYASQSNSGVPSRFSGSGSGTDFTLTINSLEAEDAATYYCHQSSSSPSSTFGQGTKVEIK

SEQ ID NO: 349 - protein, 108 aa, Artificial Sequence
  Description of Artificial Sequence: Synthetic polypeptide
EIVLTQSPDFQSVTPKEKVTITCRASQIIGTSLHWYQQKPDQSPKLLIKYASQSISGVPSRFSGSGSGTDFTLTINSLEAEDAATYYCHQSSRSPPRTFGQGTKVEIK

SEQ ID NO: 350 - protein, 108 aa, Artificial Sequence
  Description of Artificial Sequence: Synthetic polypeptide
EIVLTQSPDFQSVTPKEKVTITCRASQKIGTSLHWYQQKPDQSPKLLIKHESQSISGVPSRFSGSGSGTDFTLTINSLEAEDAATYYCHQSSGSPPPTFGQGTKVEIK

SEQ ID NO: 351 - protein, 108 aa, Artificial Sequence
  Description of Artificial Sequence: Synthetic polypeptide
EIVLTQSPDFQSVTPKEKVTITCRASQTIGGSLHWYQQKPDQSPKLLIKHVSQSVSGVPSRFSGSGSGTDFTLTINSLEAEDAATYYCHQSSISPPPTFGQGTKVEIK

SEQ ID NO: 352 - protein, 108 aa, Artificial Sequence
  Description of Artificial Sequence: Synthetic polypeptide
EIVLTQSPDFQSVTPKEKVTITCRASQSIGSDLHWYQQKPDQSPKLLIKHVSQSVSGVPSRFSGSGSGTDFTLTINSLEAEDAATYYCHQSCMSPSLTFGQGTKVEIK

SEQ ID NO: 353 - protein, 108 aa, Artificial Sequence
  Description of Artificial Sequence: Synthetic polypeptide
EIVLTQSPDFQSVTPKEKVTITCRASQSIGSNLHWYQQKPDQSPKLLIKHASQSISGVPSRFSGSGSGTDFTLTINSLEAEDAATYYCHQSSSLPNTTFGQGTKVEIK

SEQ ID NO: 354 - protein, 108 aa, Artificial Sequence
  Description of Artificial Sequence: Synthetic polypeptide
EIVLTQSPDFQSVTPKEKVTITCRASQRIGSILHWYQQKPDQSPKLLIKHASQSISGVPSRFSGSGSGTDFTLTINSLEAEDAATYYCHQGRISPSSTFGQGTKVEIK

SEQ ID NO: 355 - protein, 108 aa, Artificial Sequence
  Description of Artificial Sequence: Synthetic polypeptide
EIVLTQSPDFQSVTPKEKVTITCRASQSIGNRLHWYQQKPDQSPKLLIKHASQSLSGVPSRFSGSGSGTDFTLTINSLEAEDAATYYCHQSGSLPTLTFGQGTKVEIK

SEQ ID NO: 356 - protein, 108 aa, Artificial Sequence
  Description of Artificial Sequence: Synthetic polypeptide
EIVLTQSPDFQSVTPKEKVTITCRASQTIGSSLHWYQQKPDQSPKLLIKHDSQSLSGVPSRFSGSGSGTDFTLTINSLEAEDAATYYCHQNSSLPTHTFGQGTKVEIK

SEQ ID NO: 357 - protein, 108 aa, Artificial Sequence
  Description of Artificial Sequence: Synthetic polypeptide
EIVLTQSPDFQSVTPKEKVTITCRASQTIGRSLHWYQQKPDQSPKLLIKHGSQSISGVPSRFSGSGSGTDFTLTINSLEAEDAATYYCHQSRSSPPSTFGQGTKVEIK

SEQ ID NO: 358 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAATYYCHQNCSSPPPTFGQGTKVEIK

SEQ ID NO: 359 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYESQSDSGVPSRFSGSGSGTDFTLTINSLEAEDAATYYCHQRRNSPPSTFGQGTKVEIK

SEQ ID NO: 360 - protein, 108 aa, Artificial Sequence
  Description of Artificial Sequence: Synthetic polypeptide
EIVLTQSPDFQSVTPKEKVTITCRASQGIGSRLHWYQQKPDQSPKLLIKHGSQSISGVPSRFSGSGSGTDFTLTINSLEAEDAATYYCHQNRGLPAPTFGQGTKVEIK

SEQ ID NO: 361 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSSSGVPSRFSGSGSGTDFTLTINSLEAEDAATYYCHQNHTSPPPTFGQGTKVEIK

SEQ ID NO: 362 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKHASQSVSGVPSRFSGSGSGTDFTLTINSLEAEDAATYYCHQSGRLPPPTFGQGTKVEIK

SEQ ID NO: 363 - protein, 108 aa, Artificial Sequence
  Description of Artificial Sequence: Synthetic polypeptide
EIVLTQSPDFQSVTPKEKVTITCRASQYIGKRLHWYQQKPDQSPKLLIKYASQSISGVPSRFSGSGSGTDFTLTINSLEAEDAATYYCHQSNISPPPTFGQGTKVEIK

SEQ ID NO: 364 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHESQSISGVPSRFSGSGSGTDFTLTINSLEAEDAATYYCHQSSSLPPPTFGQGTKVEIK

SEQ ID NO: 365 - protein, 108 aa, Artificial Sequence
  Description of Artificial Sequence: Synthetic polypeptide
EIVLTQSPDFQSVTPKEKVTITCRASQTIGSSLHWYQQKPDQSPKLLIKYASQSISGVPSRFSGSGSGTDFTLTINSLEAEDAATYYCHQRSSLPPSTFGQGTKVEIK

SEQ ID NO: 366 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKHPSQSISGVPSRFSGSGSGTDFTLTINSLEAEDAATYYCHQCSSSPAQTFGQGTKVEIK

SEQ ID NO: 367 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKHTSQSLSGVPSRFSGSGSGTDFTLTINSLEAEDAATYYCHQRSSLPLPTFGQGTKVEIK

SEQ ID NO: 368 - protein, 108 aa, Artificial Sequence
  Description of Artificial Sequence: Synthetic polypeptide
EIVLTQSPDFQSVTPKEKVTITCRASQWIGSSLHWYQQKPDQSPKLLIKHTSQSISGVPSRFSGSGSGTDFTLTINSLEAEDAATYYCHQSSSLPPQTFGQGTKVEIK

SEQ ID NO: 369 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKYSSQSISGVPSRFSGSGSGTDFTLTINSLEAEDAATYYCHQGSSSPPPTFGQGTKVEIK

SEQ ID NO: 370 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQSSRLPPSTFGQGTKVEIK

SEQ ID NO: 371 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYGSQSISGVPSRFSGSGSGTDFTLTINSLEAEDAATYYCHQNWSLPLPTFGQGTKVEIK

SEQ ID NO: 372 - protein, 108 aa, Artificial Sequence
  Description of Artificial Sequence: Synthetic polypeptide
EIVLTQSPDFQSVTPKEKVTITCRASQRIGTSLHWYQQKPDQSPKLLIKYASQSKSGVPSRFSGSGSGTDFTLTINSLEAEDAATYYCHQSSCSPTPTFGQGTKVEIK

SEQ ID NO: 373 - protein, 108 aa, Artificial Sequence
  Description of Artificial Sequence: Synthetic polypeptide
EIVLTQSPDFQSVTPKEKVTITCRASQSIGGSLHWYQQKPDQSPKLLIKYGSQSISGVPSRFSGSGSGTDFTLTINSLEAEDAATYYCHQRCVSPSPTFGQGTKVEIK

SEQ ID NO: 374 - protein, 108 aa, Artificial Sequence
  Description of Artificial Sequence: Synthetic polypeptide
EIVLTQSPDFQSVTPKEKVTITCRASQSIGGTLHWYQQKPDQSPKLLIKYASQSISGVPSRFSGSGSGTDFTLTINSLEAEDAATYYCHQSSSSPARTFGQGTKVEIK

SEQ ID NO: 375 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAATYYCHQCGSSPLHTFGQGTKVEIK

SEQ ID NO: 376 - protein, 108 aa, Artificial Sequence
  Description of Artificial Sequence: Synthetic polypeptide
EIVLTQSPDFQSVTPKEKVTITCRASQSIGTSLHWYQQKPDQSPKLLIKHPSQSLSGVPSRFSGSGSGTDFTLTINSLEAEDAATYYCHQSTSSPPPTFGQGTKVEIK

SEQ ID NO: 377 - protein, 108 aa, Artificial Sequence
  Description of Artificial Sequence: Synthetic polypeptide
EIVLTQSPDFQSVTPKEKVTITCRASQNIGSSLHWYQQKPDQSPKLLIKHASQSISGVPSRFSGSGSGTDFTLTINSLEAEDAATYYCHQNSGLPLPTFGQGTKVEIK

SEQ ID NO: 378 - protein, 108 aa, Artificial Sequence
  Description of Artificial Sequence: Synthetic polypeptide
EIVLTQSPDFQSVTPKEKVTITCRASQSIGRRLHWYQQKPDQSPKLLIKYASQSISGVPSRFSGSGSGTDFTLTINSLEAEDAATYYCHQGSSSPSPTFGQGTKVEIK

SEQ ID NO: 379 - protein, 108 aa, Artificial Sequence
  Description of Artificial Sequence: Synthetic polypeptide
EIVLTQSPDFQSVTPKEKVTITCRASQRIGGNLHWYQQKPDQSPKLLIKHESQSNSGVPSRFSGSGSGTDFTLTINSLEAEDAATYYCHQSSSLPSHTFGQGTKVEIK

SEQ ID NO: 380 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSTSGVPSRFSGSGSGTDFTLTINSLEAEDAATYYCHQCSSSPSHTFGQGTKVEIK

SEQ ID NO: 381 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSMSGVPSRFSGSGSGTDFTLTINSLEAEDAATYYCHQSRNSPPTTFGQGTKVEIK

SEQ ID NO: 382 - protein, 108 aa, Artificial Sequence
  Description of Artificial Sequence: Synthetic polypeptide
EIVLTQSPDFQSVTPKEKVTITCRASQRIGSRLHWYQQKPDQSPKLLIKHGSQSISGVPSRFSGSGSGTDFTLTINSLEAEDAATYYCHQNSSSPPPTFGQGTKVEIK

SEQ ID NO: 383 - protein, 108 aa, Artificial Sequence
  Description of Artificial Sequence: Synthetic polypeptide
EIVLTQSPDFQSVTPKEKVTITCRASQNIGSSLHWYQQKPDQSPKLLIKYASQSLSGVPSRFSGSGSGTDFTLTINSLEAEDAATYYCHQSSLLPAPTFGQGTKVEIK

SEQ ID NO: 384 - protein, 108 aa, Artificial Sequence
  Description of Artificial Sequence: Synthetic polypeptide
EIVLTQSPDFQSVTPKEKVTITCRASQIIGTTLHWYQQKPDQSPKLLIKHASQSISGVPSRFSGSGSGTDFTLTINSLEAEDAATYYCHQNSNLPPSTFGQGTKVEIK

SEQ ID NO: 385 - protein, 108 aa, Artificial Sequence
  Description of Artificial Sequence: Synthetic polypeptide
EIVLTQSPDFQSVTPKEKVTITCRASQNIGGNLHWYQQKPDQSPKLLIKHASQSLSGVPSRFSGSGSGTDFTLTINSLEAEDAATYYCHQSSNLPPPTFGQGTKVEIK

SEQ ID NO: 386 - protein, 108 aa, Artificial Sequence
  Description of Artificial Sequence: Synthetic polypeptide
EIVLTQSPDFQSVTPKEKVTITCRASQGIGGSLHWYQQKPDQSPKLLIKYASQSTSGVPSRFSGSGSGTDFTLTINSLEAEDAATYYCHQSACLPTRTFGQGTKVEIK

SEQ ID NO: 387 - protein, 108 aa, Artificial Sequence
  Description of Artificial Sequence: Synthetic polypeptide
EIVLTQSPDFQSVTPKEKVTITCRASQSIGTSLHWYQQKPDQSPKLLIKYASQSVSGVPSRFSGSGSGTDFTLTINSLEAEDAATYYCHQIGSLPPPTFGQGTKVEIK

SEQ ID NO: 388 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKHASQSVSGVPSRFSGSGSGTDFTLTINSLEAEDAATYYCHQNSRLPPPTFGQGTKVEIK

SEQ ID NO: 389 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHNSQSISGVPSRFSGSGSGTDFTLTINSLEAEDAATYYCHQRSSSPPLTFGQGTKVEIK

SEQ ID NO: 390 - protein, 108 aa, Artificial Sequence
  Description of Artificial Sequence: Synthetic polypeptide
EIVLTQSPDFQSVTPKEKVTITCRASQSIGRNLHWYQQKPDQSPKLLIKHVSQSISGVPSRFSGSGSGTDFTLTINSLEAEDAATYYCHQRSRSPPSTFGQGTKVEIK

SEQ ID NO: 391 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSVSGVPSRFSGSGSGTDFTLTINSLEAEDAATYYCHQCSSLPAPTFGQGTKVEIK

SEQ ID NO: 392 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHASQSLSGVPSRFSGSGSGTDFTLTINSLEAEDAATYYCHQSSRLPPQTFGQGTKVEIK

SEQ ID NO: 393 - protein, 108 aa, Artificial Sequence
  Description of Artificial Sequence: Synthetic polypeptide
EIVLTQSPDFQSVTPKEKVTITCRASQCIGSRLHWYQQKPDQSPKLLIKYASQSISGVPSRFSGSGSGTDFTLTINSLEAEDAATYYCHQRGRLPPRTFGQGTKVEIK

SEQ ID NO: 394 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAATYYCHQSTSLPRLTFGQGTKVEIK

SEQ ID NO: 395 - protein, 108 aa, Artificial Sequence
  Description of Artificial Sequence: Synthetic polypeptide
EIVLTQSPDFQSVTPKEKVTITCRASQIIGSSLHWYQQKPDQSPKLLIKYASQSISGVPSRFSGSGSGTDFTLTINSLEAEDAATYYCHQSRSSPQQTFGQGTKVEIK

SEQ ID NO: 396 - protein, 108 aa, Artificial Sequence
  Description of Artificial Sequence: Synthetic polypeptide
EIVLTQSPDFQSVTPKEKVTITCRASQSIGSTLHWYQQKPDQSPKLLIKHASQSISGVPSRFSGSGSGTDFTLTINSLEAEDAATYYCHQSSSLPPPTFGQGTKVEIK

SEQ ID NO: 397 - protein, 108 aa, Artificial Sequence
  Description of Artificial Sequence: Synthetic polypeptide
EIVLTQSPDFQSVTPKEKVTITCRASQSIGNSLHWYQQKPDQSPKLLIKHGSQSISGVPSRFSGSGSGTDFTLTINSLEAEDAATYYCHQRRSSPRHTFGQGTKVEIK

SEQ ID NO: 398 - protein, 108 aa, Artificial Sequence
  Description of Artificial Sequence: Synthetic polypeptide
EIVLTQSPDFQSVTPKEKVTITCRASQRIGRRLHWYQQKPDQSPKLLIKHASQSISGVPSRFSGSGSGTDFTLTINSLEAEDAATYYCHQSIGSPPLTFGQGTKVEIK

SEQ ID NO: 399 - protein, 108 aa, Artificial Sequence
  Description of Artificial Sequence: Synthetic polypeptide
EIVLTQSPDFQSVTPKEKVTITCRASQSIGRGLHWYQQKPDQSPKLLIKYGSQSMSGVPSRFSGSGSGTDFTLTINSLEAEDAATYYCHQSSSLPPPTFGQGTKVEIK

SEQ ID NO: 400 - protein, 108 aa, Artificial Sequence
  Description of Artificial Sequence: Synthetic polypeptide
EIVLTQSPDFQSVTPKEKVTITCRASQSIGCSLHWYQQKPDQSPKLLIKYASQSISGVPSRFSGSGSGTDFTLTINSLEAEDAATYYCHQCTSLPLPTFGQGTKVEIK

SEQ ID NO: 401 - protein, 108 aa, Artificial Sequence
  Description of Artificial Sequence: Synthetic polypeptide
EIVLTQSPDFQSVTPKEKVTITCRASQGIGSSLHWYQQKPDQSPKLLIKYVSQSISGVPSRFSGSGSGTDFTLTINSLEAEDAATYYCHQGSSLPTPTFGQGTKVEIK

SEQ ID NO: 402 - protein, 108 aa, Artificial Sequence
  Description of Artificial Sequence: Synthetic polypeptide
EIVLTQSPDFQSVTPKEKVTITCRASQSIGTSLHWYQQKPDQSPKLLIKHASQSSSGVPSRFSGSGSGTDFTLTINSLEAEDAATYYCHQSSRLPPLTFGQGTKVEIK

SEQ ID NO: 403 - protein, 108 aa, Artificial Sequence
  Description of Artificial Sequence: Synthetic polypeptide
EIVLTQSPDFQSVTPKEKVTITCRASQVIGGVLHWYQQKPDQSPKLLIKYTSQSISGVPSRFSGSGSGTDFTLTINSLEAEDAATYYCHQSSSSPRPTFGQGTKVEIK

SEQ ID NO: 404 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHSSQSLSGVPSRFSGSGSGTDFTLTINSLEAEDAATYYCHQRSNSPHRTFGQGTKVEIK

SEQ ID NO: 405 - protein, 108 aa, Artificial Sequence
  Description of Artificial Sequence: Synthetic polypeptide
EIVLTQSPDFQSVTPKEKVTITCRASQSIGRTLHWYQQKPDQSPKLLIKYASQSISGVPSRFSGSGSGTDFTLTINSLEAEDAATYYCHQCSISPQPTFGQGTKVEIK

SEQ ID NO: 406 - protein, 108 aa, Artificial Sequence
  Description of Artificial Sequence: Synthetic polypeptide
EIVLTQSPDFQSVTPKEKVTITCRASQRIGNTLHWYQQKPDQSPKLLIKYPSQSISGVPSRFSGSGSGTDFTLTINSLEAEDAATYYCHQSGSSPPPTFGQGTKVEIK

SEQ ID NO: 407 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKYISQSMSGVPSRFSGSGSGTDFTLTINSLEAEDAATYYCHQSCGLPPPTFGQGTKVEIK

SEQ ID NO: 408 - protein, 108 aa, Artificial Sequence
  Description of Artificial Sequence: Synthetic polypeptide
EIVLTQSPDFQSVTPKEKVTITCRASQNIGTRLHWYQQKPDQSPKLLIKYGSQSLSGVPSRFSGSGSGTDFTLTINSLEAEDAATYYCHQSRISPPPTFGQGTKVEIK

SEQ ID NO: 409 - protein, 108 aa, Artificial Sequence
  Description of Artificial Sequence: Synthetic polypeptide
EIVLTQSPDFQSVTPKEKVTITCRASQSIGSTLHWYQQKPDQSPKLLIKYVSQSISGVPSRFSGSGSGTDFTLTINSLEAEDAATYYCHQCSRLPPPTFGQGTKVEIK

SEQ ID NO: 410 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKYASQSTSGVPSRFSGSGSGTDFTLTINSLEAEDAATYYCHQSSNLPSPTFGQGTKVEIK

SEQ ID NO: 411 - protein, 108 aa, Artificial Sequence
  Description of Artificial Sequence: Synthetic polypeptide
EIVLTQSPDFQSVTPKEKVTITCRASQSIGSNLHWYQQKPDQSPKLLIKHASQSMSGVPSRFSGSGSGTDFTLTINSLEAEDAATYYCHQSSSLPRPTFGQGTKVEIK

SEQ ID NO: 412 - protein, 108 aa, Artificial Sequence
  Description of Artificial Sequence: Synthetic polypeptide
EIVLTQSPDFQSVTPKEKVTITCRASQIIGSSLHWYQQKPDQSPKLLIKYASQSISGVPSRFSGSGSGTDFTLTINSLEAEDAATYYCHQSISSPSPTFGQGTKVEIK

SEQ ID NO: 413 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAATYYCHQSNCLPPPTFGQGTKVEIK

SEQ ID NO: 414 - protein, 108 aa, Artificial Sequence
  Description of Artificial Sequence: Synthetic polypeptide
EIVLTQSPDFQSVTPKEKVTITCRASQSIGKSLHWYQQKPDQSPKLLIKHESQSISGVPSRFSGSGSGTDFTLTINSLEAEDAATYYCHQANSLPPPTFGQGTKVEIK

SEQ ID NO: 415 - protein, 108 aa, Artificial Sequence
  Description of Artificial Sequence: Synthetic polypeptide
EIVLTQSPDFQSVTPKEKVTITCRASQSIGRRLHWYQQKPDQSPKLLIKYASQSISGVPSRFSGSGSGTDFTLTINSLEAEDAATYYCHQCSSSPPSTFGQGTKVEIK

SEQ ID NO: 416 - protein, 108 aa, Artificial Sequence
  Description of Artificial Sequence: Synthetic polypeptide
EIVLTQSPDFQSVTPKEKVTITCRASQIIGHSLHWYQQKPDQSPKLLIKHASQSILGVPSRFSGSGSGTDFTLTINSLEAEDAATYYCHQSIKSPPATFGQGTKVEIK

SEQ ID NO: 417 - protein, 108 aa, Artificial Sequence
  Description of Artificial Sequence: Synthetic polypeptide
EIVLTQSPDFQSVTPKEKVTITCRASQSIGTSLHWYQQKPDQSPKLLIKHTSQSKSGVPSRFSGSGSGTDFALTINSLEAEDAATYYCHQSSNSPRYTFGQGTKVEIK

SEQ ID NO: 418 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSHSGVPSRFSGSGSGTDFTLTINSLEAEDAATYYCHQSGGSPPWTFGQGTKVEIK

SEQ ID NO: 419 - protein, 108 aa, Artificial Sequence
  Description of Artificial Sequence: Synthetic polypeptide
EIVLTQSPDFQSVTPKEKVTITCRASQGIGRSLHWYQQKPDQSPKLLIKYASQSLSGVPSRFSGSGSGTDFTLTINSLEAEDAATYYCHQSNRSPPPTFGQGTKVEIK

SEQ ID NO: 420 - protein, 108 aa, Artificial Sequence
  Description of Artificial Sequence: Synthetic polypeptide
EIVLTQSPDFQSVTPKEKVTITCRASQSIGTTLHWYQQKPDQSPKLLIKHVSQSTSGVPSRFSGSGSGTDFTLTINSLEAEDAATYYCHQSSSLPHPTFGQGTKVEIK

SEQ ID NO: 421 - protein, 108 aa, Artificial Sequence
  Description of Artificial Sequence: Synthetic polypeptide
EIVLTQSPDFQSVTPKEKVTITCRASQIIGSSLHWYQQKPDQSPKLLIKYPSQSTSGVPSRFSGSGSGTDFTLTINSLEAEDAATYYCHQSWSSPLMTFGQGTKVEIK

SEQ ID NO: 422 - protein, 108 aa, Artificial Sequence
  Description of Artificial Sequence: Synthetic polypeptide
EIVLTQSPDFQSVTPKEKVTITCRASQSIGNTLHWYQQKPDQSPKLLIKHASQSISGVPSRFSGSGSGTDFTLTINSLEAEDAATYYCHQSSSSPPPTFGQGTKVEIK

SEQ ID NO: 423 - protein, 108 aa, Artificial Sequence
  Description of Artificial Sequence: Synthetic polypeptide
EIVLTQSPDFQSVTPKEKVTITCRASQRIGICLHWYQQKPDQSPKLLIKYASQSMSGVPSRFSGSGSGTDFTLTINSLEAEDAATYYCHQGFSLPPATFGQGTKVEIK

SEQ ID NO: 424 - protein, 108 aa, Artificial Sequence
  Description of Artificial Sequence: Synthetic polypeptide
EIVLTQSPDFQSVTPKEKVTITCRASQSIGSCLHWYQQKPDQSPKLLIKYPSQSTSGVPSRFSGSGSGTDFTLTINSLEAEDAATYYCHQGSCSPTTTFGQGTKVEIK

SEQ ID NO: 425 - protein, 108 aa, Artificial Sequence; identical to SEQ ID NO: 406
  Description of Artificial Sequence: Synthetic polypeptide

SEQ ID NO: 426 - protein, 108 aa, Artificial Sequence
  Description of Artificial Sequence: Synthetic polypeptide
EIVLTQSPDFQSVTPKEKVTITCRASQTIGTSLHWYQQKPDQSPKLLIKYASQSTSGVPSRFSGSGSGTDFTLTINSLEAEDAATYYCHQRCSLPPPTFGQGTKVEIK

SEQ ID NO: 427 - protein, 108 aa, Artificial Sequence
  Description of Artificial Sequence: Synthetic polypeptide
EIVLTQSPDFQSVTPKEKVTITCRASQSIGGSLHWYQQKPDQSPKLLIKYASQSHSGVPSRFSGSGSGTDFTLTINSLEAEDAATYYCHQCRISPRPTFGQGTKVEIK

SEQ ID NO: 428 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHPSQSKSGVPSRFSGSGSGTDFTLSINSLEAEDAATYYCHQTSRSPLHTFGQGTKVEIK

SEQ ID NO: 429 - protein, 108 aa, Artificial Sequence
  Description of Artificial Sequence: Synthetic polypeptide
EIVLTQSPDFQSVTPKEKVTITCRASQNIGKNLHWYQQKPDQSPKLLIKYPSQSISGVPSRFSGSGSGTDFTLTINSLEAEDAATYYCHQSRSSPLSTFGQGTKVEIK

SEQ ID NO: 430 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKYMSQSISGVPSRFSGSGSGTDFTLTINSLEAEDAATYYCHQSRVLPPPTFGQGTKVEIK

SEQ ID NO: 431 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYGSQSISGVPSRFSGSGSGTDFTLTINSLEAEDAATYYCHQSSISPRRTFGQGTKVEIK

SEQ ID NO: 432 - protein, 108 aa, Artificial Sequence
  Description of Artificial Sequence: Synthetic polypeptide
EIVLTQSPDFQSVTPKEKVTITCRASQTIGRSLHWYQQKPDQSPKLLIKYASQSISGVPSRFSGSGSGTDFTLTINSLEAEDAATYYCHQRKSSPTPTFGQGTKVEIK

SEQ ID NO: 433 - protein, 108 aa, Artificial Sequence
  Description of Artificial Sequence: Synthetic polypeptide
EIVLTQSPDFQSVTPKEKVTITCRASQRIGRQLHWYQQKPDQSPKLLIKHPSQSISGVPSRFSGSGSGTDFTLTINSLEAEDAATYYCHQSSSLPPQTFGQGTKVEIK

SEQ ID NO: 434 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHTSQSISGVPSRFSGSGSGTDFTLTINSLEAEDAATYYCHQICRSPSPTFGQGTKVEIK

SEQ ID NO: 435 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSSSGVPSRFSGSGSGTDFTLTINSLEAEDAATYYCHQSSGSPAPTFGQGTKVEIK

SEQ ID NO: 436 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYSSQSTSGVPSRFSGSGSGTDFTLTINSLEAEDAATYYCHQISSSPPPTFGQGTKVEIK

SEQ ID NO: 437 - protein, 108 aa, Artificial Sequence
  Description of Artificial Sequence: Synthetic polypeptide
EIVLTQSPDFQSVTPKEKVTITCRASQTIGNSLHWYQQKPDQSPKLLIKHASQSNSGVPSRFSGSGSGTDFTLTINSLEAEDAATYYCHQTMTSPPPTFGQGTKVEIK

SEQ ID NO: 438 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQSRSSPSPTFGQGTKVEIK

SEQ ID NO: 439 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQRRWSPPPTFGQGTKVEIK

SEQ ID NO: 440 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSNSGVPSRFSGSGSGTDFTLTINSLEAEDAATYYCHQISCLPLPTFGQGTKVEIK

SEQ ID NO: 441 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHASQSISGVPSRFSGSGSGTDFTLTINSLEAEDAATYYCHQSISLPPPTFGQGTKVEIK

SEQ ID NO: 442 - protein, 108 aa, Artificial Sequence
  Description of Artificial Sequence: Synthetic polypeptide
EIVLTQSPDFQSVTPKEKVTITCRASQSIGRNLHWYQQKPDQSPKLLIKHTSQSLSGVPSRFSGSGSGTDFTLTINSLEAEDAATYYCHQTSTLPPQTFGQGTKVEIK

SEQ ID NO: 443 - protein, 108 aa, Artificial Sequence
  Description of Artificial Sequence: Synthetic polypeptide
EIVLTQSPDFQSVTPKEKVTITCRASQSIGRSLHWYQQKPDQSPKLLIKYASQSISGVPSRFSGSGSGTDFTLTINSLEAEDAATYYCHQSRNSPQPTFGQGTKVEIK

SEQ ID NO: 444 - protein, 108 aa, Artificial Sequence
  Description of Artificial Sequence: Synthetic polypeptide
EIVLTQSPDFQSVTPKEKVTITCRASQSIGTRLHWYQQKPDQSPKLLIKYVSQSISGVPSRFSGSGSGTDFTLTINSLEAEDAATYYCHQSSHSPPPTFGQGTKVEIK

SEQ ID NO: 445 - protein, 108 aa, Artificial Sequence
  Description of Artificial Sequence: Synthetic polypeptide
EIVLTQSPDFQSVTPKEKVTITCRASQSIGSCLHWYQQKPDQSPKLLIKHRSQSISGVPSRFSGSGSGTDFTLTINSLEAEDAATYYCHQWSSSPPPTFGQGTKVEIK

SEQ ID NO: 446 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHPSQSISGVPSRFSGSGSGTDFTLTINSLEAEDAATYYCHQTSGSPSHTFGQGTKVEIK

SEQ ID NO: 447 - protein, 108 aa, Artificial Sequence
  Description of Artificial Sequence: Synthetic polypeptide
EIVLTQSPDFQSVTPKEKVTITCRASQGIGSSLHWYQQKPDQSPKLLIKYESQSISGVPSRFSGSGSGTDFTLTINSLEAEDAATYYCHQSSSSPPPTFGQGTKVEIK

SEQ ID NO: 448 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHDSQSISGVPSRFSGSGSGTDFTLTINSLEAEDAATYYCHQGSSSPPTTFGQGTKVEIK

SEQ ID NO: 449 - protein, 108 aa, Artificial Sequence
  Description of Artificial Sequence: Synthetic polypeptide
EIVLTQSPDFQSVTPKEKVTITCRASQTIGSNLHWYQQKPDQSPKLLIKHASQSISGVPSRFSGSGSGTDFTLTINSLEAEDAATYYCHQRISSPPSTFGQGTKVEIK

SEQ ID NO: 450 - protein, 108 aa, Artificial Sequence
  Description of Artificial Sequence: Synthetic polypeptide
EIVLTQSPDFQSVTPKEKVTITCRASQTIGSSLHWYQQKPDQSPKLLIKHASQSVSGVPSRFSGSGSGTDFTLTINSLEAEDAATYYCHQSCSSPPSTFGQGTKVEIK

SEQ ID NO: 451 - protein, 108 aa, Artificial Sequence
  Description of Artificial Sequence: Synthetic polypeptide
EIVLTQSPDFQSVTPKEKVTITCRASQTIGSSLHWYQQKPDQSPKLLIKYVSQSLSGVPSRFSGSGSGTDFTLTINSLEAEDAATYYCHQTISSPLPTFGQGTKVEIK

SEQ ID NO: 452 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKHASQSISGVPSRFSGSGSGTDFTLTINSLEAEDAATYYCHQSSCSPAHTFGQGTKVEIK

SEQ ID NO: 453 - protein, 108 aa, Artificial Sequence
  Description of Artificial Sequence: Synthetic polypeptide
EIVLTQSPDFQSVTPKEKVTITCRDSRCIGSNLHWYQQKPDQSPKLLIKHASQSSSGVPSRFSGSGSGTDFTLTINSLEAEDAATYYCHQCSSSPPPTFGQGTKVEIK

SEQ ID NO: 454 - protein, 108 aa, Artificial Sequence
  Description of Artificial Sequence: Synthetic polypeptide
EIVLTQSPDFQSVTPKEKVTITCRASQSIGSTLHWYQQKPDQSPKLLIKHASQSNSGVPSRFSGSGSGTDFTLTINSLEAEDAATYYCHQSSSLPPPTFGQGTKVEIK

SEQ ID NO: 455 - protein, 108 aa, Artificial Sequence
  Description of Artificial Sequence: Synthetic polypeptide
EIVLTQSPDFQSVTPKEKVTITCRASQSIGDSLHWYQQKPDQSPKLLIKHASQSKSGVPSRFSGSGSGTDFTLTINSLEAEDAATYYCHQGSTSPPRTFGQGTKVEIK

SEQ ID NO: 456 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHGSQSSSGVPSRFSGSGSGTDFTLTINSLEAEDAATYYCHQSWSSPIPTFGQGTKVEIK

SEQ ID NO: 457 - protein, 108 aa, Artificial Sequence; identical to SEQ ID NO: 410
  Description of Artificial Sequence: Synthetic polypeptide

SEQ ID NO: 458 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKHASQSTSGVPSRFSGSGSGTDFTLTINSLEAEDAATYYCHQSGSSPPRTFGQGTKVEIK

SEQ ID NO: 459 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQRTSSPVRTFGQGTKVEIK

SEQ ID NO: 460 - protein, 108 aa, Artificial Sequence
  Description of Artificial Sequence: Synthetic polypeptide
EIVLTQSPDFQSVTPKEKVTITCRASQSIGNTLHWYQQKPDQSPKLLIKHVSQSVSGVPSRFSGSGSGTDFTLTINSLEAEDAATYYCHQKVSSPSPTFGQGTKVEIK

SEQ ID NO: 461 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHASQSVSGVPSRFSGSGSGTDFTLTINSLEAEDAATYYCHQSRSSPPPTFGQGTKVEIK

SEQ ID NO: 462 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSTSGVPSRFSGSGSGTDFTLTINSLEAEDAATYYCHQSSSSPPSTFGQGTKVEIK

SEQ ID NO: 463 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAATYYCHQNSSSPSTTFGQGTKVEIK

SEQ ID NO: 464 - protein, 108 aa, Artificial Sequence
  Description of Artificial Sequence: Synthetic polypeptide
EIVLTQSPDFQSVTPKEKVTITCRASQCIGSSLHWYQQKPDQSPKLLIKHESQSSSGVPSRFSGSGSGTDFTLTINSLEAEDAATYYCHQRCTSPSPTFGQGTKVEIK

SEQ ID NO: 465 - protein, 108 aa, Artificial Sequence
  Description of Artificial Sequence: Synthetic polypeptide
EIVLTQSPDFQSVTPKEKVTITCRASQRIGSSLHWYQQKPDQSPKLLIKHPSQSDSGVPSRFSGSGSGTDFTLTINSLEAEDAATYYCHQNCSLPLPTFGQGTKVEIK

SEQ ID NO: 466 - protein, 108 aa, Artificial Sequence
  Description of Artificial Sequence: Synthetic polypeptide
EIVLTQSPDFQSVTPKEKVTITCRASQCIGSSLHWYQQKPDQSPKLLIKHASQSTSGVPSRFSGSGSGTDFTLTINSLEAEDAATYYCHQGISSPPQTFGQGTKVEIK

SEQ ID NO: 467 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHVSQSLSGVPSRFSGSGSGTDFTLTINSLEAEDAATYYCHQRSSSPSPTFGQGTKVEIK

SEQ ID NO: 468 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHPSQSLSGVPSRFSGSGSGTDFTLTINSLEAEDAATYYCHQSIRLPPSTFGQGTKVEIK

SEQ ID NO: 469 - protein, 108 aa, Artificial Sequence
  Description of Artificial Sequence: Synthetic polypeptide
EIVLTQSPDFQSVTPKEKVTITCRANQSIGGSLHWYQQKPDQSPKLLIKHASQSKSGVPSRFSGSGSGTDFTLTINSLEAEDAATYYCHQDSRSPTRTFGQGTKVEIK

SEQ ID NO: 470 - protein, 108 aa, Artificial Sequence
  Description of Artificial Sequence: Synthetic polypeptide
EIVLTQSPDFQSVTPKEKVTITCRASQSIGSGLHWYQQKPDQSPKLLIKHTSQSISGVPSRFSGSGSGTDFTLTINSLEAEDAATYYCHQSSSLPHPTFGQGTKVEIK

SEQ ID NO: 471 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSTSGVPSRFSGSGSGTDFTLTINSLEAEDAATYYCHQSSSSPTPTFGQGTKVEIK

SEQ ID NO: 472 - protein, 108 aa, Artificial Sequence
  Description of Artificial Sequence: Synthetic polypeptide
EIVLTQSPDFQSVTPKEKVTITCRASQSIGSRLHWYQQKPDQSPKLLIKYPSQSRSGVPSRFSGSGSGTDLTLTINSLEAEDAATYYCHQNGSLPPPTFGQGTKVEIK

SEQ ID NO: 473 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKHASQSISGVPSRFSGSGSGTDFTLTINSLEAEDAATYYCHQNSSSPPPTFGQGTKVEIK

SEQ ID NO: 474 - protein, 108 aa, Artificial Sequence
  Description of Artificial Sequence: Synthetic polypeptide
EIVLTQSPDFQSVTPKEKVTITCRASQSIGSALHWYQQKPDQSPKLLIKHASQSLSGVPSRFSGSGSGTDFTLTINSLEAEDAATYYCHQSSILPRPTFGQGTKVEIK

SEQ ID NO: 475 - protein, 108 aa, Artificial Sequence
  Description of Artificial Sequence: Synthetic polypeptide
EIVLTQSPDFQSVTPKEKVTITCRASQSIGSNLHWYQQKPDQSPKLLIKHASQSISGVPSRFSGSGSGTDFTLTINSLEAEDAATYYCHQTRTSPPLTFGQGTKVEIK

SEQ ID NO: 476 - protein, 108 aa, Artificial Sequence
  Description of Artificial Sequence: Synthetic polypeptide
EIVLTQSPDFQSVTPKEKVTITCRASQKIGSSLHWYQQKPDQSPKLLIKYGSQSTSGVPSRFSGSGSGTDFTLTINSLEAEDAATYYCHQCISLPTPTFGQGTKVEIK

SEQ ID NO: 477 - protein, 108 aa, Artificial Sequence
  Description of Artificial Sequence: Synthetic polypeptide
EIVLTQSPDFQSVTPKEKVAITCRASQRIGSSLHWYQQKPDQSPKLLIKYASQSISGVPSRFSGSGSGTDFTLTINSLEAEDAATYYCHQNSSLPPPTFGQGTKVEIK

SEQ ID NO: 478 - protein, 120 aa, Artificial Sequence; identical to SEQ ID NO: 236
  Description of Artificial Sequence: Synthetic polypeptide

SEQ ID NO: 479 - protein, 120 aa, Artificial Sequence; identical to SEQ ID NO: 223
  Description of Artificial Sequence: Synthetic polypeptide

SEQ ID NO: 480 - protein, 120 aa, Artificial Sequence; identical to SEQ ID NO: 256
  Description of Artificial Sequence: Synthetic polypeptide

SEQ ID NO: 481 - protein, 120 aa, Artificial Sequence; identical to SEQ ID NO: 250
  Description of Artificial Sequence: Synthetic polypeptide

SEQ ID NO: 482 - protein, 120 aa, Artificial Sequence; identical to SEQ ID NO: 266
  Description of Artificial Sequence: Synthetic polypeptide

SEQ ID NO: 483 - protein, 120 aa, Artificial Sequence; identical to SEQ ID NO: 225
  Description of Artificial Sequence: Synthetic polypeptide

SEQ ID NO: 484 - protein, 120 aa, Artificial Sequence; identical to SEQ ID NO: 239
  Description of Artificial Sequence: Synthetic polypeptide

SEQ ID NO: 485 - protein, 120 aa, Artificial Sequence; identical to SEQ ID NO: 244
  Description of Artificial Sequence: Synthetic polypeptide

SEQ ID NO: 486 - protein, 120 aa, Artificial Sequence; identical to SEQ ID NO: 237
  Description of Artificial Sequence: Synthetic polypeptide

SEQ ID NO: 487 - protein, 108 aa, Artificial Sequence; identical to SEQ ID NO: 460
  Description of Artificial Sequence: Synthetic polypeptide

SEQ ID NO: 488 - protein, 107 aa, Artificial Sequence
  Description of Artificial Sequence: Synthetic polypeptide
EIVLTQSPDFQSVTPKEKVTITCRASQSIGSTLHWYQQKPDQSPKLLIKHASQSNSGVPSRFSGSGSGTDFTLTINSLEAEDAATYYCHQSSSLPPPTFGQGTKVEI

SEQ ID NO: 489 - protein, 108 aa, Artificial Sequence; identical to SEQ ID NO: 458
  Description of Artificial Sequence: Synthetic polypeptide

SEQ ID NO: 490 - protein, 108 aa, Artificial Sequence; identical to SEQ ID NO: 461
  Description of Artificial Sequence: Synthetic polypeptide

SEQ ID NO: 491 - protein, 108 aa, Artificial Sequence; identical to SEQ ID NO: 462
  Description of Artificial Sequence: Synthetic polypeptide

SEQ ID NO: 492 - protein, 108 aa, Artificial Sequence
  Description of Artificial Sequence: Synthetic polypeptide
EIVLTQSPDFQSVTPKEKVTITCRASQTIGSSLHWYQQKPDQSPKLLIKHASQSISGVPSRFSGSGSGTDFTLTINSLEAEDAATYYCHQTSSLPTPTFGQGTKVEIK

SEQ ID NO: 493 - protein, 108 aa, Artificial Sequence
  Description of Artificial Sequence: Synthetic polypeptide
EIVLTQSPDFQSVTPKEKVTITCRASQTIGSSLHWYQQKPDQSPKLLIKHASQSISGVPSRFSGSGSGTDFTLTINSLEAEDAATYYCHQSSSSPPPTFGQGTKVEIK

SEQ ID NO: 494 - protein, 108 aa, Artificial Sequence; identical to SEQ ID NO: 467
  Description of Artificial Sequence: Synthetic polypeptide

SEQ ID NO: 495 - protein, 108 aa, Artificial Sequence; identical to SEQ ID NO: 475
  Description of Artificial Sequence: Synthetic polypeptide

SEQ ID NO: 496 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRGDGSTDYASTLKSRFTISRDNSKNTLYLQMNSLRAEDTAVYYCAREWQHGPVAYWGQGTLVTVSS

SEQ ID NO: 497 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRGDGSTDYADSVKSRFTISRDNSKNTLYLQMNSLRAEDTAVYYCAREWHHGPVAYWGQGTLVTVSS

SEQ ID NO: 498 - protein, 117 aa, Artificial Sequence
  Description of Artificial Sequence: Synthetic polypeptide
EVQLVESGGGLVQPGGSLRLSCAASGFTFSAYGVNWVRQAPGKGLEWVSIIWGDGATDYADSVKGRFTISRDNSKNTLYLQMNSLRAEDTAVYYCAREWHHGPVAYWGQGTLVTVSS

SEQ ID NO: 499 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMISSDGFTDYASSVKSRFTISRDNSKNTLYLQMNSLRAEDTAVYYCAREWQHGPVAYWGQGTLVTVSS

SEQ ID NO: 500 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIAADGSTDYASSVKGRFTISRDNSKNTLYLQMNSLRAEDTAVYYCAREWQHGPVAYWGQGTLVTVSS

SEQ ID NO: 501 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGSTDYASSLKSRFTISRDNSKNTLYLQMNSLRAEDTAVYYCAREWHHGPVAYWGQGTLVTVSS

SEQ ID NO: 502 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRDDGSTDYADTVKGRFTISRDNSKNTLYLQMNSLRAEDTAVYYCAREWHHGPVAYWGQGTLVTVSS

SEQ ID NO: 503 - protein, 117 aa, Artificial Sequence
  Description of Artificial Sequence: Synthetic polypeptide
EVQLVESGGGLVQPGGSLRLSCAASGFTFSHIGVSWVRQAPGKGLEWVSMISYAGSTDYASTVKGRFTISRDNSKNTLYLQMNSLRAEDTAVYYCARLLHKGPIDYWGQGTLVTVSS

SEQ ID NO: 504 - protein, 117 aa, Artificial Sequence
  Description of Artificial Sequence: Synthetic polypeptide
EVQLVESGGGLVQPGGSLRLSCAASGFTFSDFGVNWVRQAPGKGLEWVSMIWSDGSTDYADTVKSRFTISRDNSKNTLYLQMNSLRAEDTAVYYCAREWHHGPVAYWGQGTLVTVSS

SEQ ID NO: 505 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRADGSTDYASSLKGRFTISRDNSKNTLYLQMNSLRAEDTAVYYCAREWHHGPVAYWGQGTLVTVSS

SEQ ID NO: 506 - protein, 117 aa, Artificial Sequence
  Description of Artificial Sequence: Synthetic polypeptide
EVQLVESGGGLVQPGGSLRLSCAASGFTFSNYGVQWVRQAPGKGLEWVSMIRGDGSTDYASSLKGRFTISRDNSKNTLYLQMNSLRAEDTAVYYCARPSHHGLIDNWGQGTLVTVSS

SEQ ID NO: 507 - protein, 117 aa, Artificial Sequence
  Description of Artificial Sequence: Synthetic polypeptide
EVQLVESGGGLVQPGGSLRLSCAASGFTFSELGVNWVRQAPGKGLEWVSYISDVGSTYYASTVKGRFTISRDNSKNTLYLQMNSLRAEDTAVYYCARDWHHGRFDYWGQGTLVTVSS

SEQ ID NO: 508 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSLIRADGSTDYADSLKGRFTISRDNSKNTLYLQMNSLRAEDTAVYYCAREWHHGPVAYWGQGTLVTVSS

SEQ ID NO: 509 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGFTDYADSVKGRFTISRDNSKNTLYLQMNSLRAEDTAVYYCARDWQHGPSVYWGQGTLVTVSS

SEQ ID NO: 510 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSIIRADGVTDYASSVKGRFTISRDNSKNTLYLQMNSLRAEDTAVYYCAREWHHGPVAYWGQGTLVTVSS

SEQ ID NO: 511 - protein, 117 aa, Artificial Sequence
  Description of Artificial Sequence: Synthetic polypeptide
EVQLVESGGGLVQPGGSLRLSCAASGFTFSNYGVHWVRQAPGKGLEWVSMIGADGYTDYADSLKGRFTISRDNSKNTLYLQMNSLRAEDTAVYYCAREWHHGPVAYWGQGTLVTVSS

SEQ ID NO: 512 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMISADGSTDYASSVKGRFTISRDNSKNTLYLQMNSLRAEDTAVYYCAREWHHGPVAYWGQGTLVTVSS

SEQ ID NO: 513 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRSDGFTDYADSVKGRFTISRDNSKNTLYLQMNSLRTEDTAVYYCAREWHHGPVAYWGQGTLVTVSS

SEQ ID NO: 514 - protein, 117 aa, Artificial Sequence
  Description of Artificial Sequence: Synthetic polypeptide
EVQLVESGGGLVQPGGSLRLSCAASGFTFSEYGVNWVRQAPGKGLEWVSIIWHDGSTAYADTVKSRFTISRDNSKNTLYLQMNSLRAEDTAVYYCAREWHHGPVAYWGQGTLVTVSS

SEQ ID NO: 515 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSLIRGDGSTDYASSVKSRFTISRDNSKNTLYLQMNSLRAEDTAVYYCAREWHHGPVAYWGQGTLVTVSS

SEQ ID NO: 516 - protein, 117 aa, Artificial Sequence
  Description of Artificial Sequence: Synthetic polypeptide
EVQLVESGGGLVQPGGSLRLSCAASGFTFSNFGVSWVRQAPGKGLEWVSMIWGDGSTDYADSLKGRFTISRDNSKNTLYLQMNSLRAEDTAVYYCAREWHHGPVAYWGQGTLVTVSS

SEQ ID NO: 517 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRDDGSTYYASTVKGRFTISRDNSKNTLYLQMNSLRAEDTAVYYCAREWQHGPLGYWGQGTLVTVSS

SEQ ID NO: 518 - protein, 117 aa, Artificial Sequence
  Description of Artificial Sequence: Synthetic polypeptide
EVQLVESGGGLVQPGGSLRLSCAASGFTFSDFGVNWVRQAPGKGLEWVSMIWAGGSTAYASTVKGRFTISRDNSKNTLYLQMNSLRAEDTAVYYCAREWHHGPVAYWGQGTLVTVSS

SEQ ID NO: 519 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSLIGADGSTDYASTVKGRFTISRDNSKNTLYLQMNSLRAEDTAVYYCAREWQYGPLAYWGQGTLVTVSS

SEQ ID NO: 520 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIEGDGGTHYASSVKGRFTISRDNSKNTLYLQMNSLRAEDTAVYYCAREWHHGPVAYWGQGTLVTVSS

SEQ ID NO: 521 - protein, 117 aa, Artificial Sequence; identical to SEQ ID NO: 42
  Description of Artificial Sequence: Synthetic polypeptide

SEQ ID NO: 522 - protein, 117 aa, Artificial Sequence
  Description of Artificial Sequence: Synthetic polypeptide
  MOD_RES (41)..(41): Any amino acid
EVQLVESGGGLVQPGGSLRLSCAASGFTFSNYGVNWVRQAXGKGLEWVSMISADGTTDYASSVKGRFTISRDNSKNTLYLQMNSLRAEDTAVYYCAREWHHGPVAYWGQGTLVTVSS

SEQ ID NO: 523 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSIIRGDGTTDYASTVKGRFTISRDNSKNTLYLQMNSLRAEDTAVYYCAREWQHGPLGYWGQGTLVTVSS

SEQ ID NO: 524 - protein, 117 aa, Artificial Sequence
  Description of Artificial Sequence: Synthetic polypeptide
EVQLVESGGGLVQPGGSLRLSCAASGFTFSHYGVGWVRQAPGKGLEWVSMIWGAGSTNYADTVKSRFTISRDNSKNTLYLQMNSLRAEDTAVYYCAREWHHGPVAYWGQGTLVTVSS

SEQ ID NO: 525 - protein, 117 aa, Artificial Sequence
  Description of Artificial Sequence: Synthetic polypeptide
EVQLVESGGGLVQPGGSLRLSCAASGFTFSSFGVNWVRQAPGKGLEWVSMIWADGTTDYADSLKGRFTISRDNSKNTLYLQMNSLRAEDTAVYYCAREWHHGPVAYWGQGTLVTVSS

SEQ ID NO: 526 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSVIGGDGYTDYADSVKGRFTISRDNSKNTLYLQMNSLRAEDTAVYYCAREWQHGPVAYWGQGTLVTVSS

SEQ ID NO: 527 - protein, 117 aa, Artificial Sequence
  Description of Artificial Sequence: Synthetic polypeptide
  MOD_RES (43)..(43): Any amino acid
EVQLVESGGGLVQPGGSLRLSCAASGFTFSNYGVTWVRQAPGXGLEWVSMISSDGYTDYASSVKGRFTISRDNSKNTLYLQMNSLRAEDTAVYYCAREWHHGPVAYWGQGTLVTVSS

SEQ ID NO: 528 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWSDGSTHYADTVKSRFTISRDNSKNTLYLQMNSLRAEDTAVYYCAREWHHGPVAYWGQGTLVTVSS

SEQ ID NO: 529 - protein, 117 aa, Artificial Sequence
  Description of Artificial Sequence: Synthetic polypeptide
EVQLVESGGGLVQPGGSLRLSCAASGFTFSQLGVTWVRQAPGKGLEWVSTISDAGSTYYASSVKGRFTIIRINSKNTLYLQMNSLRAEDTAVYYCARDWHHGRFAYWGQGTLVTVSS

SEQ ID NO: 530 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRGDGSTYYASSLKGRFTISRDNSKNTLYLQMNSLRAEDTAVYYCAREWHHGPVAYWGQGTLVTVSS

SEQ ID NO: 531 - protein, 117 aa, Artificial Sequence
  Description of Artificial Sequence: Synthetic polypeptide
EVQLVESGGGLVQPGGSLRLSCAASGFTFSNYGVQWVRQAPGKGLEWVSMIRDDGSTSYASTVKGRFTISRDNSKNTLYLQMNSLRAEDTAVYYCAREWHHGPVAYWGQGTLVTVSS

SEQ ID NO: 532 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSIIRGDGSTDYASSVKSRFTISRDNSKNTLYLQMNSLRAEDTAVYYCAREWQHGPVAYWGQGTLVTVSS

SEQ ID NO: 533 - protein, 117 aa, Artificial Sequence
  Description of Artificial Sequence: Synthetic polypeptide
EVQLVESGGGLVQPGGSLRLSCAASGFTFSAYGVNWVRQAPGKGLEWVSMISGDGSTDYADSVKSRFTISRDNSKNTLYLQMNSLRAEDTAVYYCAREWHHGPVAYWGQGTLVTVSS

SEQ ID NO: 534 - protein, 117 aa, Artificial Sequence
  Description of Artificial Sequence: Synthetic polypeptide
EVQLVESGGGLVQPGGSLRLSCAASGFTFSHFGVTWVRQAPGKGLEWVSNIWASGSTDYADSVKGRFTISRDNSKNTLYLQMNSLRAEDTAVYYCAREWHHGPVAYWGQGTLVTVSS

SEQ ID NO: 535 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGSTDYADSVKGRFTISRDNSKNTLYLQMNSLRAEDTAVYYCAREWQHGPVGYWGQGTLVTVSS

SEQ ID NO: 536 - protein, 117 aa, Artificial Sequence
  Description of Artificial Sequence: Synthetic polypeptide
EVQLVESGGGLVQPGGSLRLSCAASGFTFSNFGVNWVRQAPGKGLEWVSVIWGDGSTAYASSVKSRFTISRDNSKNTLYLQMNSLRAEDTAVYYCAREWHHGPVAYWGQGTLVTVSS

SEQ ID NO: 537 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRGDGSTDYASSVKGRFTISRDNSKNTLYLQMNSLRAEDTAVYYCAREWQHGPLAYWGQGTLVTVSS

SEQ ID NO: 538 - protein, 117 aa, Artificial Sequence; identical to SEQ ID NO: 39
  Description of Artificial Sequence: Synthetic polypeptide

SEQ ID NO: 539 - protein, 117 aa, Artificial Sequence; identical to SEQ ID NO: 38
  Description of Artificial Sequence: Synthetic polypeptide

SEQ ID NO: 540 - protein, 117 aa, Artificial Sequence; identical to SEQ ID NO: 35
  Description of Artificial Sequence: Synthetic polypeptide

SEQ ID NO: 541 - protein, 117 aa, Artificial Sequence
  Description of Artificial Sequence: Synthetic polypeptide
EVQLVESGGGLVQPGGSLRISCAASGFTFSAFGVSWVRQAPGKGLEWVSMIWGDGSTDYASSVKGRFTISRDNSKNTLYLQMNSLRAEDTAVYYCAREWHHGPVAYWGQGTLVTVSS

SEQ ID NO: 542 - protein, 117 aa, Artificial Sequence
  Description of Artificial Sequence: Synthetic polypeptide
EVQLVESGGGLVQPGGSLRLSCAASGFTFSDLGVNWVRQAPGKGLEWVSTISDIGSTYYASTVKGRFTISRDNSKNTLYLQMNSLRAEDTAVYYCARDWHNGRFDYWGQGTLVTVSS

SEQ ID NO: 543 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRGDGFTDYADSVKGRFTISRDNSKNTLYLQMNSLRAEDTAVYYCAREWHHGPVAYWGQGTLVTVSS

SEQ ID NO: 544 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSIIRADGSTDYASSVKGRFTISRDNSKNTLYLQMNSLRAEDTAVYYCAREWHHGPVAYWGQGTLVTVSS

SEQ ID NO: 545 - protein, 117 aa, Artificial Sequence
  Description of Artificial Sequence: Synthetic polypeptide
EVQLVESGGGLVQPGGSLRLSCAASGFTFSHFGVNWVRQAPGKGLEWVSIIWGDGSTAYASSVKGRFTISRDNSKNTLYLQMNSLRAEDTAVYYCAREWHHGPVAYWGQGTLVTVSS

SEQ ID NO: 546 - protein, 117 aa, Artificial Sequence
  Description of Artificial Sequence: Synthetic polypeptide
EVQLVESGGGLVQPGGSLRLSCAASGFTFSNYGVEWVRQAPGKGLEWVSKIWADGSTDYADSLKSRFTISRDNSKNTLYLQMNSLRAEDTAVYYCAREWQHGPLAYWGQGTLVTVSS

SEQ ID NO: 547 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSLIWGDGTTDYASSVKGRFTISRDNSKNTLYLQMNSLRAEDTAVYYCAREWHHGPVAYWGQGTLVTVSS

SEQ ID NO: 548 - protein, 117 aa, Artificial Sequence
  Description of Artificial Sequence: Synthetic polypeptide
EVQLVESGGGLVQPGGSLRLSCAASGFTFSYFGVSWVRQAPGKGLEWVSMIWGDGSTDYADSVKGRFTISRDNSKNTLYLQMNSLRAEDTAVYYCAREWHHGPVAYWGQGTLVTVSS

SEQ ID NO: 549 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRSDGSTDYADTLKGRFTISRDNSKNTLYLQMNSLRAEDTAVYYCAREWQHGPLAYWGQGTLVTVSS

SEQ ID NO: 550 - protein, 117 aa, Artificial Sequence
  Description of Artificial Sequence: Synthetic polypeptide
EVQLVESGGGLVQPGGSLRLSCAASGFTFSDFGVNWVRQAPGKGLEWVSIIWSDGSTDYASSLKGRFTISRDNSKNTLYLQMNSLRAEDTAVYYCAREWHHGPVAYWGQGTLVTVSS

SEQ ID NO: 551 - protein, 117 aa, Artificial Sequence; identical to SEQ ID NO: 52
  Description of Artificial Sequence: Synthetic polypeptide

SEQ ID NO: 552 - protein, 117 aa, Artificial Sequence
  Description of Artificial Sequence: Synthetic polypeptide
EVQLVESGGGLVQPGGSLRLSCAASGFTFSEFGVNWVRQAPGKGLEWVSMIWGNGATDYASSVKSRFTISRDNSKNTLYLQMNSLRAEDTAVYYCAREWHHGPVAYWGQGTLVTVSS

SEQ ID NO: 553 - protein, 117 aa, Artificial Sequence
  Description of Artificial Sequence: Synthetic polypeptide
EVQLVESGGGLVQPGGSLRLSCAASGFTFSDFGVNWVRQAPGKGLEWVSMIWGDGTTAYASSVKSRFTISRDNSKNTLYLQMNSLRAEDTAVYYCAREWHHGPVAYWGQGTLVTVSS

SEQ ID NO: 554 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGSTDYASSVKGRFTISRDNSKNTLYLQMNSLRAEDTAVYYCAREWHHGPVAYWGQGTLVTVSS

SEQ ID NO: 555 - protein, 117 aa, Artificial Sequence
  Description of Artificial Sequence: Synthetic polypeptide
EVQLVESGGGLVQPGGSLRLSCAASGFTFSDFGVNWVRQAPGKGLEWVSMIWGDGSTDYADSLKGRFTISRDNSKNTLYLQMNSLRAEDTAVYYCAREWHHGPVAYWGQGTLVTVSS

SEQ ID NO: 556 - protein, 117 aa, Artificial Sequence
  Description of Artificial Sequence: Synthetic polypeptide
  MOD_RES (41)..(41): Any amino acid
EVQLVESGGGLVQPGGSLRLSCAASGFTFSNFGVNWVRQAXGKGLEWVSMIWGDGSTDYADSLKGRFTISRDNSKNTLYLQMNSLRAEDTAVYYCAREWHHGPVAYWGQGTLVTVSS

SEQ ID NO: 557 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIGSDGFTDYASSLKGRFTISRDNSKNTLYLQMNSLRAEDTAVYYCAREWQHGPVAYWGQGTLVTVSS

SEQ ID NO: 558 - protein, 117 aa, Artificial Sequence
  Description of Artificial Sequence: Synthetic polypeptide
EVQLVESGGGLVQPGGSLRLSCAASGFTFSNYGVTWVRQTPGKGLEWVSMIRGDGSTDYASSVKGRFTISRDNSKNTLYLQMNSLRAEDTAVYYCAREWHHGPVAYWGQGTLVTVSS

SEQ ID NO: 559 - protein, 117 aa, Artificial Sequence
  Description of Artificial Sequence: Synthetic polypeptide
EVQLVESGGGLVQPGGSLRLSCAASGFTFSDFGVSWVRQAPGKGLEWVSQIWGDGSTDYADSLKGRFTISRDNSKNTLYLQMNSLRAEDTAVYYCAREWHHGPVAYWGQGTLVTVSS

SEQ ID NO: 560 - protein, 117 aa, Artificial Sequence
  Description of Artificial Sequence: Synthetic polypeptide
EVQLVESGGGLVQPGGSLRLSCAASGFTFSQLGVTWVRQAPGKGLEWVSTISDAGSTYYASSVKGRFTISRDNSKNTLYLQMNSLRAEDTAVYYCARDWHHGRFAYWGQGTLVTVSS

SEQ ID NO: 561 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGSTDYASSVKGRFTISRDNSKNTLYLQMNSLRAEDTAVYYCARDWQHGPLGYWGQGTLVTVSS

SEQ ID NO: 562 - protein, 117 aa, Artificial Sequence
  Description of Artificial Sequence: Synthetic polypeptide
EVQLVESGGGLVQPGGSLRLSCAASGFTFSAYGVHWVRQAPGKGLEWVSMIWGDGSTDYADSVKSRFTISRDNSKNTLYLQMNSLRAEDTAVYYCAREWHHGPVAYWGQGTLVTVSS

SEQ ID NO: 563 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRGDGTTDYASSVKGRFTISRDNSKNTLYLQMNSLRAEDTAVYYCARDWQHGPIGYWGQGTLVTVSS

SEQ ID NO: 564 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGYTDYADSVKGRFTISRDNSKNTLYLQMNSLRAEDTAVYYCAREWQHGPLAYWGQGTLVTVSS

SEQ ID NO: 565 - protein, 117 aa, Artificial Sequence
  Description of Artificial Sequence: Synthetic polypeptide
EVQLVESGGGLVQPGGSLRLSCAASGFTFSNYGVEWVRQAPGKGLEWVSKIWGDGTTDYADTLKGRFTISRDNSKNTLYLQMNSLRAEDTAVYYCAREWHHGPVAYWGQGTLVTVSS

SEQ ID NO: 566 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIGGEGRTDYADSVKGRFTISRDNSKNTLYLQMNSLRAEDTAVYYCAREWHHGPVAYWGQGTLVTVSS

SEQ ID NO: 567 - protein, 117 aa, Artificial Sequence
  Description of Artificial Sequence: Synthetic polypeptide
EVQLVESGGGLVQPGGSLRLSCAASGFTFSNLGVNWVRQAPGKGLEWVSMIWDVGSTDYASSVKGRFTISRDNSKNTLYLQMNSLRAEDTAVYYCARDWHHGLFDYWGQGTLVTVSS

SEQ ID NO: 568 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIMGDGYTDYADSVKGRFTISRDNSKNTLYLQMNSLRAEDTAVYYCAREWQHGPVAYWGQGTLVTVSS

SEQ ID NO: 569 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRDDGATDYADSVKGRFTISRDNSKNTLYLQMNSLRAEDTAVYYCAREWQHGPLAYWGQGTLVTVSS

SEQ ID NO: 570 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMISGDGYTDYADSVKGRFTISRDNSKNTLYLQMNSLRAEDTAVYYCAREWQHGPLAYWGQGTLVTVSS

SEQ ID NO: 571 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSIIRGDGSTDYADSVKGRFTISRDNSKNTLYLQMNSLRAEDTAVYYCAREWHHGPVAYWGQGTLVTVSS

SEQ ID NO: 572 - protein, 117 aa, Artificial Sequence
  Description of Artificial Sequence: Synthetic polypeptide
  MOD_RES (43)..(43): Any amino acid
EVQLVESGGGLVQPGGSLRLSCAASGFTFSNFGVNWVRQAPGXGLEWVSMIWADGSTDYASTLKGRFTISRDNSKNTLYLQMNSLRAEDTAVYYCAREWHHGPVAYWGQGTLVTVSS

SEQ ID NO: 573 - protein, 117 aa, Artificial Sequence
  Description of Artificial Sequence: Synthetic polypeptide
EVQLVESGGGLVQPGGSLRLSCAASGFTFSAFGVCWVRQAPGKGLEWVSMIWADGSTDYASSVKGRFTISRDNSKNTLYLQMNSLRAEDTAVYYCAREWHHGPVAYWGQGTLVTVSS

SEQ ID NO: 574 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRSDGSTDYASSVKSRFTISRDNSKNTLYLQMNSLRAEDTAVYYCARDWQHGPEGYWGQGTLVTVSS

SEQ ID NO: 575 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIRGDGSTDYASSVKGRFTISRDNSKNTLYLQMNSLRAEDTAVYYCAREWHHGPVAYWGQGTLVTVSS

SEQ ID NO: 576 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSLIRSDGSTHYADSLKGRFTISRDNSKNTLYLQMNSLRAEDTAVYYCAREWHHGPVAYWGQGTLVTVSS

SEQ ID NO: 577 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIRGDGYTDYASSVKGRFTISRDNSKNTLYLQMNSLRAEDTAVYYCAREWHHGPVAYWGQGTLVTVSS

SEQ ID NO: 578 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYADSLKGRFTISRDNSKNTLYLQMNSLRAEDTAVYYCAREWQHGPVAYWGQGTLVTVSS

SEQ ID NO: 579 - protein, 117 aa, Artificial Sequence; identical to SEQ ID NO: 51
  Description of Artificial Sequence: Synthetic polypeptide

SEQ ID NO: 580 - protein, 117 aa, Artificial Sequence
  Description of Artificial Sequence: Synthetic polypeptide
EVQLVESGGGLVQPGGSLILSCAASGFTFSNYGVSWVRQAPGKGLEWVSMIWADGSTHYASSLKGRFTISRDNFKNTLYLQMNSLRAEDTAVYYCAREWQHGPVAYWGQGTLVTVSS

SEQ ID NO: 581 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIRGDGFTDYASSVKGRFTISRDNSKNTLYLQMNSLRAEDTAVYYCAREWHHGPVAYWGQGTLVTVSS

SEQ ID NO: 582 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIAADGSTAYADSLKGRFTISRDNSKNTLYLQMNSLRAEDTAVYYCAREWHHGPVAYWGQGTLVTVSS

SEQ ID NO: 583 - protein, 117 aa, Artificial Sequence; identical to SEQ ID NO: 40
  Description of Artificial Sequence: Synthetic polypeptide

SEQ ID NO: 584 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRGDGSTDYADTVKGRFTISRDNSKNTLYLQMNSLRAEDTAVYYCAREWHHGPVAYWGQGTLVTVSS

SEQ ID NO: 585 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIISGDGFTDYASSVKGRFTISRDNSKNTLYLQMNSLRAEDTAVYYCAREWHHGPVAYWGQGTLVTVSS

SEQ ID NO: 586 - protein, 117 aa, Artificial Sequence
  Description of Artificial Sequence: Synthetic polypeptide
EVQLVESGGGLVQPGGSLRLSCAASGFTFSDWGVHWMRQAPGKGLEWVSTIWDDGSTYYASSVKSRFTISRDNSKNTLYLQMNSLRAEDTAVYYCARHGHHGPFVYWGQGTLVTVSS

SEQ ID NO: 587 - protein, 117 aa, Artificial Sequence
  Description of Artificial Sequence: Synthetic polypeptide
  MOD_RES (26)..(26): Any amino acid
EVQLVESGGGLVQPGGSLRLSCAASXFTFSNFGVNWVRQAPGKGLEWVSMIWGDGSTDYADSVKSRFTISRDNSKNTLYLQMNSLRAEDTAVYYCAREWHHGPVAYWGQGTLVTVSS

SEQ ID NO: 588 - protein, 117 aa, Artificial Sequence
  Description of Artificial Sequence: Synthetic polypeptide
EVQLVESGGGLVQPGGSLRLSCAASGFTFSVYGVNWVRQAPGKGLEWVSMIGDEGSTDYASTVKGRFTISRDNSKNTLYLQMNSLRAEDTAVYYCARHWHHGAVDYWGQGTLVTVSS

SEQ ID NO: 589 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSMIWADGSTHYADSLKSRFTISRDNSKNTLYLQMNSLRAEDTAVYYCAREWHHGPVAYWGQGTLVTVSS

SEQ ID NO: 590 - protein, 117 aa, Artificial Sequence; identical to SEQ ID NO: 45
  Description of Artificial Sequence: Synthetic polypeptide

SEQ ID NO: 591 - protein, 117 aa, Artificial Sequence; identical to SEQ ID NO: 53
  Description of Artificial Sequence: Synthetic polypeptide

SEQ ID NO: 592 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRGDGFTDYASSVKGRFTISRDNSKNTLYLQMNSLRAEDTAVYYCAREWQHGPVAYWGQGTLVTVSS

SEQ ID NO: 593 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGYTSYASSVKGRFTISRDNSKNTLYLQMNSLRAEDTAVYYCAREWHHGPVAYWGQGTLVTVSS

SEQ ID NO: 594 - protein, 117 aa, Artificial Sequence; identical to SEQ ID NO: 43
  Description of Artificial Sequence: Synthetic polypeptide

SEQ ID NO: 595 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIRADGSTDYASSVKSRFTISRDNSKNTLYLQMNSLRAEDTAVYYCAREWHHGPVAYWGQGTLVTVSS

SEQ ID NO: 596 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGTTDYASSVKSRFTISRDNSKNTLYLQMNSLRAEDTAVYYCAREWQHGPVGYWGQGTLVTVSS

SEQ ID NO: 597 - protein, 117 aa, Artificial Sequence
  Description of Artificial Sequence: Synthetic polypeptide
EVQLVESGGGLVQPGGSLRLSCAASGFTFSNFGVHWVRQAPGKGLEWVSMIWADGSTVYASSVKSRFTISRDNSKNTLYLQMNSLRAEDTAVYYCAREWHHGPVAYWGQGTLVTVSS

SEQ ID NO: 598 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIGSDGSTYYADSLKSRFTISRDNSKNTLYLQMNSLRAEDTAVYYCAREWHHGPVAYWGQGTLVTVSS

SEQ ID NO: 599 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRGDGFTDYASSVKGRFTISRDNSKNTLYLQMNSLRAEDTAVYYCAREWQHGPLGYWGQGTLVTVSS

SEQ ID NO: 600 - protein, 117 aa, Artificial Sequence
  Description of Artificial Sequence: Synthetic polypeptide
EVQLVESGGGLVQPGGSLRLSCAASGFTFSDFGVNWVRQAPGKGLEWVSMIWGDGHTAYASSVKSRFTISRDNSKNTLYLQMNSLRAEDTAVYYCAREWHHGPVAYWGQGTLVTVSS

SEQ ID NO: 601 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSMIWAHGATHYASSVKGRFTISRDNSKNTLYLQMNSLRAEDTAVYYCAREWHHGPVAYWGQGTLVTVSS

SEQ ID NO: 602 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSLIRDDGSTDYASTLKGRFTISRDNSKNTLYLQMNSLRAEDTAVYYCAREWHHGPVAYWGQGTLVTVSS

SEQ ID NO: 603 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWGDGSTDYADSVKSRFTISRDNSKNTLYLQMNSLRAEDTAVYYCAREWHHGPVAYWGQGTLVTVSS

SEQ ID NO: 604 - protein, 117 aa, Artificial Sequence; identical to SEQ ID NO: 44
  Description of Artificial Sequence: Synthetic polypeptide

SEQ ID NO: 605 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMISADGYTDYADSLKSRFTISRDNSKNTLYLQMNSLRAEDTAVYYCAREWQHGPVAYWGQGTLVTVSS

SEQ ID NO: 606 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWHHGPVAYWGQGTLVTVSS

SEQ ID NO: 607 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIGADGYTDYASTVKGRFTISRDNSKNTLYLQMNSLRAEDTAVYYCAREWHHGPVAYWGQGTLVTVSS

SEQ ID NO: 608 - protein, 117 aa, Artificial Sequence
  Description of Artificial Sequence: Synthetic polypeptide
EVQLVESGGGLVQPGGSLRLSCAASGFTFSAFGVSWVRQAPGKGLEWVSMIWADGSTDYADSVKSRFTISRDNSKNTLYLQMNSLRAEDTAVYYCAREWHHGPVAYWGQGTLVTVSS

SEQ ID NO: 609 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSLIRGDGSTDYASSLKGRFTISRDNSKNTLYLQMNSLRAEDTAVYYCAREWHHGPVAYWGQGTLVTVSS

SEQ ID NO: 610 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGTTYYADSVKGRFTISRDNSKNTLYLQMNSLRAEDTAVYYCAREWQHGPLAYWGQGTLVTVSS

SEQ ID NO: 611 - protein, 117 aa, Artificial Sequence
  Description of Artificial Sequence: Synthetic polypeptide
EVQLVESGGGLVQPGGSLRLSCAASGFTFSNYGVQWVRQAPGKGLEWVSRISGDGSTDYASSVKGRFTISRDNSKNTLYLQMNSLRAEDTAVYYCAREWHHGPVAYWGQGTLVTVSS

SEQ ID NO: 612 - protein, 117 aa, Artificial Sequence
  Description of Artificial Sequence: Synthetic polypeptide
EVQLVESGGGLVQPGGSLRLSCAASGFSFSNFGVNWVRQAPGKGLEWVSMIWADGSTNYADTVKSRFTISRDNSKNTLYLQMNSLRAEDTAVYYCAREWHHGPVAYWGQGTLVTVSS

SEQ ID NO: 613 - protein, 117 aa, Artificial Sequence
  Description of Artificial Sequence: Synthetic polypeptide
EVQLVESGGGLVQPGGSLRLSCAASGFTFSAYGVSWVRQAPGKGLEWVSIISADGSTDYASSVKGRFTISRDNSKNTLYLQMNSLRAEDTAVYYCAREWHHGPVAYWGQGTLVTVSS

SEQ ID NO: 614 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRGDGSTDYADSLKGRFTISRDNSKNTLYLQMNSLRAEDTAVYYCAREWQHGPVAYWGQGTLVTVSS

SEQ ID NO: 615 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIGADGYTDYADSVKGRFTISRDNSKNTLYLQMNSLRAEDTAVYYCAREWHHGPVAYWGQGTLVTVSS

SEQ ID NO: 616 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSIIRGDGSTDYASTVKGRFTISRDNSKNTLYLQMNSLRAEDTAVYYCAREWHHGPVAYWGQGTLVTVSS

SEQ ID NO: 617 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSMIWGSGATDYADSVKSRFTISRDNSKNTLYLQMNSLRAEDTAVYYCAREWHHGPVAYWGQGTLVTVSS

SEQ ID NO: 618 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMISADGFTDYADSVKGRFTISRDNSKNTLYLQMNSLRAEDTAVYYCAREWQHGPVAYWGQGTLVTVSS

SEQ ID NO: 619 - protein, 117 aa, Artificial Sequence; identical to SEQ ID NO: 34
  Description of Artificial Sequence: Synthetic polypeptide

SEQ ID NO: 620 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSLIAADGSTDYASSVKGRFTISRDNSKNTLYLQMNSLRAEDTAVYYCAREWQHGPVAYWGQGTLVTVSS

SEQ ID NO: 621 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSIIRGDGSTAYADTVKGRFTISRDNSKNTLYLQMNSLRAEDTAVYYCAREWHHGPVAYWGQGTLVTVSS

SEQ ID NO: 622 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIWGDGNTGYASSVKGRFTISRDNSKNTLYLQMNSLRAEDTAVYYCAREWHHGPVAYWGQGTLVTVSS

SEQ ID NO: 623 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRGDGSTDYADSVKGRFTISRDNSKNTLYLQMNSLRAEDTAVYYCAREWQHGPLAYWGQGTLVTVSS

SEQ ID NO: 624 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSMIWGDGSTEYADTLKGRFTISRDNSKNTLYLQMNSLRAEDTAVYYCAREWHHGPVAYWGQGTLVTVSS

SEQ ID NO: 625 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPVGYWGQGTLVTVSS

SEQ ID NO: 626 - protein, 117 aa, Artificial Sequence
  Description of Artificial Sequence: Synthetic polypeptide
EVQLVESGGGLVQPGGSLRLSCAASGFTFSNYGVYWVRQAPGKGLEWVSMIWDDGSTEYADSVKSRFTISRDNSKNTLYLQMNSLRAEDTAVYYCAREWHHGPVAYWGQGTLVTVSS

SEQ ID NO: 627 - protein, 117 aa, Artificial Sequence; identical to SEQ ID NO: 560
  Description of Artificial Sequence: Synthetic polypeptide

SEQ ID NO: 628 - protein, 117 aa, Artificial Sequence
  Description of Artificial Sequence: Synthetic polypeptide
EVQLVESGGGLVQPGGSLRLSCAASGFTFSGPGVNWVRQAPGKGLEWVSSIWDDGSTYYASSVKSRFTISRDNSKNTLYLQMNSLRAEDTAVYYCARHSHDGRFDYWGQGTLVTVSS

SEQ ID NO: 629 - protein, 117 aa, Artificial Sequence; identical to SEQ ID NO: 46
  Description of Artificial Sequence: Synthetic polypeptide

SEQ ID NO: 630 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSMIWGEGSTGYASSVKGRFTISRDNSKNTLYLQMNSLRAEDTAVYYCAREWHHGPVAYWGQGTLVTVSS

SEQ ID NO: 631 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRDDGFTDYASSVKGRFTISRDNSKNTLYLQMNSLRAEDTAVYYCAREWHHGPVAYWGQGTLVTVSS

SEQ ID NO: 632 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIGGDGSTDYASSVKGRFTISRDNSKNTLYLQMNSLRAEDTAVYYCAREWQHGPVAYWGQGTLVTVSS

SEQ ID NO: 633 - protein, 117 aa, Artificial Sequence
  Description of Artificial Sequence: Synthetic polypeptide
EVQLVESGGGLVQPGGSLRLSCAASGFTFSDFGVNWVRQAPGKGLEWVSMIWADGTTDYDDSVKGRFTISRDNSKNTLYLQMNSLRAEDTAVYYCAREWHHGPVAYWGQGTLVTVSS

SEQ ID NO: 634 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSGISADGSTAYDSSLKGRFTISRDNSKNTLYLQMNSLRAEDTAVYYCAREWHHGPVAYWGQGTLVTVSS

SEQ ID NO: 635 - protein, 117 aa, Artificial Sequence
  Description of Artificial Sequence: Synthetic polypeptide
EVQLVESGGGLVQPGGSLRLSCAASGFTFSSYGVSWVRQAPGKGLEWVSLIRGDGSTYYASTVKGRFTISRDNSKNTLYLQMNSLRAEDTAVYYCAREWHHGPVAYWGQGTLVTVSS

SEQ ID NO: 636 - protein, 117 aa, Artificial Sequence
  Description of Artificial Sequence: Synthetic polypeptide
EVQLVESGGGLVQPGGSLRLSCAASGFTFSNFGVNWVRQAPGKGLEWVSMIWGDGSTDYASSVKSRFTISRDNSKNTLYLQMNSLRAEDTAVYYCAREWHHGPVAYWGQGTLVTVSS

SEQ ID NO: 637 - protein, 117 aa, Artificial Sequence
  Description of Artificial Sequence: Synthetic polypeptide
EVQLVESGGGLVQPGGSLRLSCAASGFTFSHFGVNWVRQAPGKGLEWVSMIWADGSTDYASSLKGRFTISRDNSKNTLYLQMNSLRAEDTAVYYCAREWHHGPVAYWGQGTLVTVSS

SEQ ID NO: 638 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPAAYWGQGTLVTVSS

SEQ ID NO: 639 - protein, 117 aa, Artificial Sequence
  Description of Artificial Sequence: Synthetic polypeptide
EVQLVESGGGLVQPGGSLRLSCAASGFTFSNYGVHWVRQAPGKGLEWVSMIAGDGSTDYASSVKSRFTISRDNSKNTLYLQMNSLRAEDTAVYYCAREWQHGPVGYWGQGTLVTVSS

SEQ ID NO: 640 - protein, 117 aa, Artificial Sequence; identical to SEQ ID NO: 36
  Description of Artificial Sequence: Synthetic polypeptide

SEQ ID NO: 641 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSIIGADGATDYADSVKSRFTISRDNSKNTLYLQMNSLRAEDTAVYYCAREWQHGPLGYWGQGTLVTVSS

SEQ ID NO: 642 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSGITGDGITAYASTLKSRFTISRDNSKNTLYLQMNSLRAEDTAVYYCAREWHHGPVAYWGQGTLVTVSS

SEQ ID NO: 643 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMISGDGFTDYASSVKSRFTISRDNSKNTLYLQMNSLRAEDTAVYYCAREWHHGPVAYWGQGTLVTVSS

SEQ ID NO: 644 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSNIWGDGSTDYASSLKGRFTISRDNSKNTLYLQMNSLRAEDTAVYYCAREWHHGPVAYWGQGTLVTVSS

SEQ ID NO: 645 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIRADGSTDYADSLKGRFTISRDNSKNTLYLQMNSLRAEDTAVYYCAREWHHGPVAYWGQGTLVTVSS

SEQ ID NO: 646 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRGDGSTDYADSVKGRFTISRDNSKNTLYLQMNSLRAEDTAVYYCAREWHHGPVAYWGQGTLVTVSS

SEQ ID NO: 647 - protein, 117 aa, Artificial Sequence
  Description of Artificial Sequence: Synthetic polypeptide
EVQLVESGGGLVQPGGSLRLSCAASGFTFSAYGVSWVRQAPGKGLEWVSMIWRDGSTDYADSLKGRFTISRDNSKNTLYLQMNSLRAEDTAVYYCAREWHHGPVAYWGQGTLVTVSS

SEQ ID NO: 648 - protein, 117 aa, Artificial Sequence
  Description of Artificial Sequence: Synthetic polypeptide
EVQLVESGGGLVQPGGSLRLSCAASGFTFSNYGVHWVRQAPGKGLEWVSMIWGDGSTHYASSVKSRFTISRDNSKNTLYLQMNSLRAEDTAVYYCAREWHHGPVAYWGQGTLVTVSS

SEQ ID NO: 649 - protein, 117 aa, Artificial Sequence
  Description of Artificial Sequence: Synthetic polypeptide
EVQLVESGGGLVQPGGSLRLSCAASGFTFSNYGVHWVRQAPGKGLEWVSGISADGSTDYASSVKSRFTISRDNSKNTLYLQMNSLRAEDTAVYYCAREWHHGPVAYWGQGTLVTVSS

SEQ ID NO: 650 - protein, 117 aa, Artificial Sequence
  Description of Artificial Sequence: Synthetic polypeptide
EVQLVESGGGLVQPGGSLRLSCAASGFTFSHYGVNWVRQAPGKGLEWVSMIGGDGFTDYASSVKGRFTISRDNSKNTLYLQMNSLRAEDTAVYYCAREWHHGPVAYWGQGTLVTVSS

SEQ ID NO: 651 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIRADGSTDYASSLKSRFTISRDNSKNTLYLQMNSLRAEDTAVYYCAREWHHGPVAYWGQGTLVTVSS

SEQ ID NO: 652 - protein, 117 aa, Artificial Sequence
  Description of Artificial Sequence: Synthetic polypeptide
EVQLVESGGGLVQPGGSLRLSCAASGFTFSNYGVQWVRQAPGKGLEWVSVISADGFTDYASSVKGRFTISRDNSKNTLYLQMNSLRAEDTAVYYCAREWHHGPVAYWGQGTLVTVSS

SEQ ID NO: 653 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIGADGSTDYASSVKSRFTISRDNSKNTLYLQMNSLRAEDTAVYYCAREWQHGPVGYWGQGTLVTVSS

SEQ ID NO: 654 - protein, 117 aa, Artificial Sequence; identical to SEQ ID NO: 37
  Description of Artificial Sequence: Synthetic polypeptide

SEQ ID NO: 655 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSLIRGDGYTDYASSVKGRFTISRDNSKNTLYLQMNSLRAEDTAVYYCAREWHHGPVAYWGQGTLVTVSS

SEQ ID NO: 656 - protein, 117 aa, Artificial Sequence
  Description of Artificial Sequence: Synthetic polypeptide
EVQLVESGGGLVQPGGSLRLSCAASGFTFSHYGVSWVRQAPGKGLEWVSVIRADGVTDYASSVKGRFTISRDNSKNTLYLQMNSLRAEDTAVYYCAREWQHGPVGYWGQGTLVTVSS

SEQ ID NO: 657 - protein, 117 aa, Artificial Sequence; identical to SEQ ID NO: 41
  Description of Artificial Sequence: Synthetic polypeptide

SEQ ID NO: 658 - protein, 117 aa, Artificial Sequence
  Description of Artificial Sequence: Synthetic polypeptide
EVQLVESGGGLVQPGGSLRLSCAASGFTFSNYGVQWVRQAPGKGLEWVSRINGDGSTDYASTLKGRFTISRDNSKNTLYLQMNSLRAEDTAVYYCAREWHHGPVAYWGQGTLVTVSS

SEQ ID NO: 659 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIRSDGFTDYASSVKGRFTISRDNSKNTLYLQMNSLRAEDTAVYYCAREWHHGPVAYWGQGTLVTVSS

SEQ ID NO: 660 - protein, 117 aa, Artificial Sequence
  Description of Artificial Sequence: Synthetic polypeptide
EVQLVESGGGLVQPGGSLRLSCAASGFTFSNFGVNWVRQAPGKGLEWVSMIWVDGSTDYADSVKSRFTISRDNSKNTLYLQMNSLRAEDTAVYYCAREWHHGPVAYWGQGTLVTVSS

SEQ ID NO: 661 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSMIWGDGSTYYASSVKSRFTISRDNSKNTLYLQMNSLRAEDTAVYYCAREWHHGPVAYWGQGTLVTVSS

SEQ ID NO: 662 - protein, 117 aa, Artificial Sequence
  Description of Artificial Sequence: Synthetic polypeptide
EVQLVESGGGLVQPGGSLRLSCAASGFTFSHYGVSWVRQAPGKGLEWVSMIRSDGFTDYASTVKGRFTISRDNSKNTLYLQMNSLRAEDTAVYYCAREWHHGPVAYWGQGTLVTVSS

SEQ ID NO: 663 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMITGDGYTDYADTVKGRFTISRDNSKNTLYLQMNSLRAEDTAVYYCAREWQHGPLAYWGQGTLVTVSS

SEQ ID NO: 664 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRADGLTDYADSVKSRFTISRDNSKNTLYLQMNSLRAEDTAVYYCAREWHHGPVAYWGQGTLVTVSS

SEQ ID NO: 665 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSLIRSDGSTDYASSVKSRFTISRDNSKNTLYLQMNSLRAEDTAVYYCAREWHHGPVAYWGQGTLVTVSS

SEQ ID NO: 666 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGSTDYADSVKGRFTISRDNSKNTLYLQMNSLRAEDTAVYYCAREWQHGPLAYWGQGTLVTVSS

SEQ ID NO: 667 - protein, 117 aa, Artificial Sequence
  Description of Artificial Sequence: Synthetic polypeptide
EVQLVESGGGLVQPGGSLRLSCAASGFTFSDYGVIWVRQAPGKGLEWVSMIGGDGSTYYDSSLKGRFTISRDNSKNTLYLQMNSLRAEDTAVYYCAREWHHGPVAYWGQGTLVTVSS

SEQ ID NO: 668 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIGSDGSTDYASSVKGRFTISRDNSKNTLYLQMNSLRAEDTAVYYCAREWHHGPVAYWGQGTLVTVSS

SEQ ID NO: 669 - protein, 117 aa, Artificial Sequence
  Description of Artificial Sequence: Synthetic polypeptide
EVQLVESGGGLVQPGGSLRLSCAASGFTFSYYGVHWVRQAPGKGLEWVSGISGEGSTDYASSVKGRFTISRDNSKNTLYLQMNSLRAEDTAVYYCAREWHHGPVAYWGQGTLVTVSS

SEQ ID NO: 670 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRGDGSTYYASSVKSRFTISRDNSKNTLYLQMNSLRAEDTAVYYCAREWHHGPVAYWVKGTLVTVSS

SEQ ID NO: 671 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSIIRGDGSTDYASSLKSRFTISRDNSKNTLYLQMNSLRAEDTAVYYCAREWHHGPVAYWGQGTLVTVSS

SEQ ID NO: 672 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIRADGTTDYASSVKGRFTISRDNSKNTLYLQMNSLRAEDTAVYYCAREWHHGPVAYWGQGTLVTVSS

SEQ ID NO: 673 - protein, 117 aa, Artificial Sequence; identical to SEQ ID NO: 48
  Description of Artificial Sequence: Synthetic polypeptide

SEQ ID NO: 674 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIRGDGSTYYADTLKGRFTISRDNSKNTLYLQMNSLRAEDTAVYYCAREWHHGPVAYWGQGTLVTVSS

SEQ ID NO: 675 - protein, 117 aa, Artificial Sequence
  Description of Artificial Sequence: Synthetic polypeptide
EVQLVESGGGLVQPGGSLRLSCAASGFTFSHFGVNWVRQAPGKGLEWVSMIWADGSTSYADSVKSRFTISRDNSKNTLYLQMNSLRAEDTAVYYCAREWHHGPVAYWGQGTLVTVSS

SEQ ID NO: 676 - protein, 107 aa, Artificial Sequence
  Description of Artificial Sequence: Synthetic polypeptide
DIQMTQSPSSLSASVGDRVTITCRASQKVSSAVAWYQQKPGKAPKLLIYWASTRHTGVPSRFSGSGSGTDFTLTISSLQPEDFATYYCQQHYHTPYTFGQGTKLEIK

SEQ ID NO: 677 - protein, 107 aa, Artificial Sequence
  Description of Artificial Sequence: Synthetic polypeptide
DIQMTQSPSSLSASVGDRVTITCKASQAVSTEVAWYQQKPGKAPKLLIYCASTRQTGVPSRFSGSGSGTDFTLTISSLQPEDFATYYCQQSYSAPYTFGQGTKLEIK

SEQ ID NO: 678 - protein, 107 aa, Artificial Sequence
  Description of Artificial Sequence: Synthetic polypeptide
DIQMTQSPSSLSASVGDRVTITCRASQVVSSAVAWYQQKPGKAPKLLIYWASKRHTGVPSRFSGSGSGTDFTLTISSLQPEDFATYYCQQHYSTPFTFGQGTKLEIK

SEQ ID NO: 679 - protein, 107 aa, Artificial Sequence
  Description of Artificial Sequence: Synthetic polypeptide
DIQMTQSPSSLSASVGDRVTITCRASQAVSSAVAWYQQKPGKAPKLLIYWASTRHTGVPSRFSGSGSGTDFTLTISSLQPEDFATYYCQQHYSTPFTFGQGTKLEIK

SEQ ID NO: 680 - protein, 107 aa, Artificial Sequence
  Description of Artificial Sequence: Synthetic polypeptide
DIQMTQSPSSLSASVGDRVTITCKASQKVSSALAWYQQKPGKAPKLLIYWASALHSGVPSRFSGSGSGTDFTLTISSLQPEDFATYYCQQHYRPPFTFGQGTKLEIK

SEQ ID NO: 681 - protein, 107 aa, Artificial Sequence
  Description of Artificial Sequence: Synthetic polypeptide
DIQMTQSPSSLSASVGDRVTITCRASQGVSSAVAWYQQKPGKAPKLLIYWASTRHTGVPSRFSGSGSGTDFTLTISSLQPEDFATYYCQQHYTTPFTFGQGTKLEIK

SEQ ID NO: 682 - protein, 107 aa, Artificial Sequence
  Description of Artificial Sequence: Synthetic polypeptide
DIQMTQSPSSLSASVGDRVTITCRASQGVSRALAWYQQKPGKAPKLLIYWASTLHSGVPSRFSGSGSGTDFTLTISSLQPEDFATYYCQQHYRAPFTFGQGTKLEIK

SEQ ID NO: 683 - protein, 107 aa, Artificial Sequence
  Description of Artificial Sequence: Synthetic polypeptide
DIQMTQSPSSLSASVGDRVTITCRASQAVSSAVAWYQQKPGKAPKLLIYWASTRHTGVPSRFSGSGSGTDFTLTISSLQPEDFATYYCQQHYHTPFTFGQGTKLEIK

SEQ ID NO: 684 - protein, 107 aa, Artificial Sequence
  Description of Artificial Sequence: Synthetic polypeptide
DIQMTQSPSSLSASVGDRVTITCKASQGVSSALAWYQQKPGKAPKLLIYWASTRHSGVPSRFSGSGSGTDFTLTISSLQPEDFATYYCQQHYRTPFTFGQGTKLEIK

SEQ ID NO: 685 - protein, 107 aa, Artificial Sequence
  Description of Artificial Sequence: Synthetic polypeptide
DIQMTQSPSSLSASVGDRVTITCKASQGVSSALAWYQQKPGKAPKLLIYWASTRHSGVPSRFSGSGSGTDFTLTISSLQPEDFATYYCQQHYSTPYTFGQGTKLEIK

SEQ ID NO: 686 - protein, 107 aa, Artificial Sequence
  Description of Artificial Sequence: Synthetic polypeptide
DIQMTQSPSSLSASVGDRVTITCKASQWVSSAVAWYQQKPGKAPKLLIYWASTRQSGVPSRFSGSGSGTDFTLTISSLQPEDFATYYCQQHYRIPFTFGQGTKLEIK

SEQ ID NO: 687 - protein, 107 aa, Artificial Sequence
  Description of Artificial Sequence: Synthetic polypeptide
DIQMTQSPSSLSASVGDRVTITCKASQAVSSALAWYQQKPGKAPKLLIYWASTRHSGVPSRFSGSGSGTDFTLTISSLQPEDFATYYCQQHYSTPYTFGQGTKLEIK

SEQ ID NO: 688 - protein, 107 aa, Artificial Sequence
  Description of Artificial Sequence: Synthetic polypeptide
DIQMTQSPSSLSASVGDRVTITCKASQRVSSAVAWYQQKPGKAPKLLIYWASTLHTGVPSRFSGSGSGTDFTLTISSLQPEDFATYYCQQHYSTPYTFGQGTKLEIK

SEQ ID NO: 689 - protein, 107 aa, Artificial Sequence
  Description of Artificial Sequence: Synthetic polypeptide
DIQMTQSPSSLSASVGDRVTITCKASQGVSSAVAWYQQKPGKAPKLLIYWASTRHTGVPSRFSGSGSGTDFTLTISSLQPEDFATYYCQQHYNTPFTFGQGTKLEIK

SEQ ID NO: 690 - protein, 107 aa, Artificial Sequence
  Description of Artificial Sequence: Synthetic polypeptide
DIQMTQSPSSLSASVGDRVTITCKASQKVSSAVAWYQQKPGKAPKLLIYWASARHTGVPSRFSGSGSGTDFTLTISSLQPEDFATYYCQQHYSTPFTFGQGTKLEIK

SEQ ID NO: 691 - protein, 107 aa, Artificial Sequence
  Description of Artificial Sequence: Synthetic polypeptide
  MOD_RES (30)..(30): Any amino acid
DIQMTQSPSSLSASVGDRVTITCKASQTVXRAVAWYQQKPGKAPKLLIYWASTRQSGVPSRFSGSGSGTDFTLTISSLQPEDFATYYCQQSYSTPFTFGQGTKLEIK

SEQ ID NO: 692 - protein, 107 aa, Artificial Sequence
  Description of Artificial Sequence: Synthetic polypeptide
DIQMTQSPSSLSASVGDRVTITCRASQRVSSAVAWSQQKPGKAPKLLIYWASTRHSGVPSRFSGSGSGTDFTLTISSLQPEDFATYYCQQHYTTPYTFGQGTKLEIK

SEQ ID NO: 693 - protein, 107 aa, Artificial Sequence
  Description of Artificial Sequence: Synthetic polypeptide
DIQMTQSPSSLSASVGDRVTITCKASQAVSSAVAWYQQKPGKAPKLLIYWASTRHSGVPSRFSGSGSGTDFTLTISSLQPEDFATYYCQQHYSTPFTFGQGTKLEIK

SEQ ID NO: 694 - protein, 107 aa, Artificial Sequence
  Description of Artificial Sequence: Synthetic polypeptide
DIQMTQSPSSLSASVGDRVTITCKASQLVSSAVAWYQQKPGKAPKLLIYWASALHTGVPSRFSGSGSGTDFTLTISSLQPEDFATYYCQQHYSSPYTFGQGTKLEIK

SEQ ID NO: 695 - protein, 107 aa, Artificial Sequence
  Description of Artificial Sequence: Synthetic polypeptide
DIQMTQSPSSLSASVGDRVTITCKASQLVSSAVAWYQQKPGKAPKLLIYWASTRHTGVPSRFSGSGSGTDFTLTISSLQPEDFATYYCQQHYSTPFTFGQGTKLEIK

SEQ ID NO: 696 - protein, 107 aa, Artificial Sequence
  Description of Artificial Sequence: Synthetic polypeptide
DIQMTQSPSSLSASVGDRVTITCKASQKVSSAVAWYQQKPGKAPKLLIYWASARHSGVPSRFSGSGSGTDFTLTISSLQPEDFATYYCQQHYRSPFTFGQGTKLEIK

SEQ ID NO: 697 - protein, 107 aa, Artificial Sequence
  Description of Artificial Sequence: Synthetic polypeptide
DIQMTQSPSSLSASVGDRVTITCRASQAVSTALAWYQQKPGKAPKLLIYSASTLQSGVPSRFSGSGSGTDFTLTISSLQPEDFATYYCQQHYRSPFTFGQGTKLEIK

SEQ ID NO: 698 - protein, 107 aa, Artificial Sequence
  Description of Artificial Sequence: Synthetic polypeptide
DIQMTQSPSSLSASVGDRVTITCKASQYVGGAVAWYQQKPGKAPKLLIYQASTLQTGVPSRFSGSGSGTDFTLTISSLQPEDFATYYCQQHISKPFTFGQGTKLEIK

SEQ ID NO: 699 - protein, 107 aa, Artificial Sequence
  Description of Artificial Sequence: Synthetic polypeptide
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIK

SEQ ID NO: 700 - protein, 107 aa, Artificial Sequence
  Description of Artificial Sequence: Synthetic polypeptide
DIQMTQSPSSLSASVGDRVTITCKASQSVNGALAWYQQKPGKAPKLLIYRASTRQTGVPSRFSGSGSGTDFTLTISSLQPEDFATYYCQQHYSIPFTFGQGTKLEIK

SEQ ID NO: 701 - protein, 107 aa, Artificial Sequence
  Description of Artificial Sequence: Synthetic polypeptide
DIQMTQSPSSLSASVGDRVTITCRASQGVSSALAWYQQKPGKAPKLLIYWASALHSGVPSRFSGSGSGTDFTLTISSLQPEDFATYYCQQHYSAPFTFGQGTKLEIK

SEQ ID NO: 702 - protein, 107 aa, Artificial Sequence
  Description of Artificial Sequence: Synthetic polypeptide
DIQMTQSPSSLSASVGDRVTITCKASQAVSSSVAWYQQKPGKAPKLLIYGASTLQSGVPSRFSGSGSGTDFTLTISSLQPEDFATYYCQQHYNEPYTFGQGTKLEIK

SEQ ID NO: 703 - protein, 107 aa, Artificial Sequence
  Description of Artificial Sequence: Synthetic polypeptide
DIQMTQSPSSLSASVGDRVTITCKASQKVSSAVAWYQQKPGKAPKLLIYWASARHSGVPSRFSGSGSGTDFTLTISSLQPEDFATYYCQQHYRTPYTFGQGTKLEIK

SEQ ID NO: 704 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASTRHSGVPSRFSGSGSGTDFTLTISSLQPEDFATYYCQQHYRTPFSFGQGTKLEIK

SEQ ID NO: 705 - protein, 107 aa, Artificial Sequence
  Description of Artificial Sequence: Synthetic polypeptide
DIQMTQSPSSLSASVGDRVTITCRASQAVSSAVAWYQQKPGKAPKLLIYWASKRQTGVPSRFSGSGSGTDFTLTISSLQPEDFATYYCQQHYISPYTFGQGTKLEIK

SEQ ID NO: 706 - protein, 107 aa, Artificial Sequence
  Description of Artificial Sequence: Synthetic polypeptide
DIQMTQSPSSLSASVGDRVTITCKASQGVRSALAWYQQKPGKAPKLLIYWASTRHTGVPSRFSGSGSGTDFTLTISSLQPEDFATYYCQQSYSAPYTFGQGTKLEIK

SEQ ID NO: 707 - protein, 107 aa, Artificial Sequence
  Description of Artificial Sequence: Synthetic polypeptide
DIQMTQSPSSLSASVGDRVTITCKASQTVSNAVAWYQQKPGKAPKLLIYWASTRHSGVPSRFSGSGSGTDFTLTISSLQPEDFATYYCQQHYSTPFTFGQGTKLEIK

SEQ ID NO: 708 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYRTPFTFGQGTKLEIK

SEQ ID NO: 709 - protein, 107 aa, Artificial Sequence
  Description of Artificial Sequence: Synthetic polypeptide
DIQMTQSPSSLSASVGDRVTITCKASQPVRSAVAWYQQKPGKAPKLLIYSASTRQTGVPSRFSGSGSGTDFTLTISSLQPEDFATYYCQQSYSIPFTFGQGTKLEIK

SEQ ID NO: 710 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFSFGQGTKLEIK

SEQ ID NO: 711 - protein, 107 aa, Artificial Sequence
  Description of Artificial Sequence: Synthetic polypeptide
DIQMTQSPSSLSASVGDRVTITCRASQAVSSAVAWYQQKPGKAPKLLIYWASSRHTGVPSRFSGSGSGTDFTLTISSLQPEDFATYYCQQHYSTPFTFGQGTKLEIK

SEQ ID NO: 712 - protein, 107 aa, Artificial Sequence
  Description of Artificial Sequence: Synthetic polypeptide
DIQMTQSPSSLSASVGDRVTITCKASQTVGRAVAWYQQKPGKAPKLLIYWASTRQSGVPSRFSGSGSGTDFTLTISSLQPEDFATYYCQQSYSTPFTFGQGTKLEIK

SEQ ID NO: 713 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASTRHTGVPSRFSGSGSGTDFTLTISSLQPEDFATYYCQQHYRTPFTFGQGTKLEIK

SEQ ID NO: 714 - protein, 107 aa, Artificial Sequence
  Description of Artificial Sequence: Synthetic polypeptide
DIQMTQSPSSLSASVGDRVTITCRASQKVSNAVAWYQQKPGKAPKLLIYWASTRHTGVPSRFSGSGSGTDFTLTISSLQPEDFATYYCQQHYNSPFTFGQGTKLEIK

SEQ ID NO: 715 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIK

SEQ ID NO: 716 - protein, 107 aa, Artificial Sequence
  Description of Artificial Sequence: Synthetic polypeptide
DIQMTQSPSSLSASVGDRVTITCRASQRVSSAVAWYQQKPGKAPKLLIYWASTRHSGVPSRFSGSGSGTDFTLTISSLQPEDFATYYCQQHYTTPYTFGQGTKLEIK

SEQ ID NO: 717 - protein, 107 aa, Artificial Sequence
  Description of Artificial Sequence: Synthetic polypeptide
DIQMTQSPSSLSASVGDRVTITCKASQRVSSAVAWYQQKPGKAPKLLIYWASNRHSGVPSRFSGSGSGTDFTLTISSLQPEDFATYYCQQHYSTPFTFGQGTKLEIK

SEQ ID NO: 718 - protein, 107 aa, Artificial Sequence
  Description of Artificial Sequence: Synthetic polypeptide
DIQMTQSPSSLSASVGDRVTITCKASQLVSSALAWYQQKPGKAPKLLIYWASTRQSGVPSRFSGSGSGTDFTLTISSLQPEDFATYYCQQHYRTPFTFGQGTKLEIK

SEQ ID NO: 719 - protein, 107 aa, Artificial Sequence
  Description of Artificial Sequence: Synthetic polypeptide
DIQMTQSPSSLSASVGDRVTITCKASQLVSSALAWYQQKPGKAPKLLIYWASTRHTGVPSRFSGSGSGTDFTLTISSLQPEDFATYYCQQHYRNPFTFGQGTKLEIK

SEQ ID NO: 720 - protein, 107 aa, Artificial Sequence
  Description of Artificial Sequence: Synthetic polypeptide
  MOD_RES (41)..(41): Any amino acid
DIQMTQSPSSLSASVGDRVTITCKASQAVSSALAWYQQKPXKAPKLLIYWASSRQSGVPSRFSGSGSGTDFTLTISSLQPEDFATYYCQQHYRTPFTFGQGTKLEIK

SEQ ID NO: 721 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASTLHTGVPSRFSGSGSGTDFTLTISSLQPEDFATYYCQQHYRTPFTFGQGTKLEIK

SEQ ID NO: 722 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASTRHSGVPSRFSGSGSGTDFTLTISSLQPEDFATYYCQQHYRTPFTFGQGTKLEIK

SEQ ID NO: 723 - protein, 107 aa, Artificial Sequence
  Description of Artificial Sequence: Synthetic polypeptide
DIQMTQSPSSLSASVGDRVTITCKASQPVSGAVAWYQQKPGKAPKLLIYWASTRHTGVPSRFSGSGSGTDFTLTISSLQPEDFATYYCQQHYRASYTFGQGTKLEIK

SEQ ID NO: 724 - protein, 107 aa, Artificial Sequence
  Description of Artificial Sequence: Synthetic polypeptide
DIQMTQSPSSLSASVGDRVTITCRASQKVSSAVAWYQQKPGKAPKLLIYWASARHTGVPSRFSGSGSGTDFTLTISSLQPEDFATYYCQQHYRTPYTFGQGTKLEIK

SEQ ID NO: 725 - protein, 107 aa, Artificial Sequence; identical to SEQ ID NO: 716
  Description of Artificial Sequence: Synthetic polypeptide

SEQ ID NO: 726 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASTLHSGVPSRFSGSGSGTDFTLTISSLQPEDFATYYCQQHYSTPFTFGQGTKLEIK

SEQ ID NO: 727 - protein, 107 aa, Artificial Sequence
  Description of Artificial Sequence: Synthetic polypeptide
DIQMTQSPSSLSASVGDRVTITCRASQAVSSAVAWYQQKPGKAPKLLIYWASARHTGVPSRFSGSGSGTDFTLTISSLQPEDFATYYCQQHYSSPYTFGQGTKLEIK

SEQ ID NO: 728 - protein, 107 aa, Artificial Sequence
  Description of Artificial Sequence: Synthetic polypeptide
DIQMTQSPSSLSASVGDRVTITCKASQPVSSAVAWYQQKPGKAPKLLIYWASTLHSGVPSRFSGSGSGTDFTLTISSLQPEDFATYYCQQHYRTPFTFGQGTKLEIK

SEQ ID NO: 729 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASTRHTGVPSRFSGSGSGTDFTLTISSLQPEDFATYYCQQHYRTPYTFGQGTNLEIK

SEQ ID NO: 730 - protein, 107 aa, Artificial Sequence
  Description of Artificial Sequence: Synthetic polypeptide
DIQMTQSPSSLSASVGDIVTITCKASQLVSSAVAWYQQKPGKAPKLLIYWASTRHTGVPSRFSGSGSGTDFTLTISSLQPEDFATYYCQQHYRTPYTFGQGTKLEIK

SEQ ID NO: 731 - protein, 107 aa, Artificial Sequence
  Description of Artificial Sequence: Synthetic polypeptide
DIQMTQSPSSLSASVGDRVTITCKASQLVSSAVAWYQQKPGKAPKLLIYWASMRHSGVPSRFSGSGSGTDFTLTISSLQPEDFATYYCQQHYSSPFTFGQGTKLEIK

SEQ ID NO: 732 - protein, 107 aa, Artificial Sequence
  Description of Artificial Sequence: Synthetic polypeptide
DIQMTQSPSSLSASVGDRVTITCKASQTVSSAVAWYQQKPGKAPKLLIYWASTRHSGVPSRFSGSGSGTDFTLTISSLQPEDFATYYCQQHYRAPYTFGQGTKLEIK

SEQ ID NO: 733 - protein, 107 aa, Artificial Sequence
  Description of Artificial Sequence: Synthetic polypeptide
DIQMTQSPSSLSASVGDRVTITCKASQRVSSALAWYQQKPGKAPKLLIYWASTRHTGVPSRFSGSGSGTDFTLTISSLQPEDFATYYCQQHYSTPFTFGQGTKLEIK

SEQ ID NO: 734 - protein, 107 aa, Artificial Sequence
  Description of Artificial Sequence: Synthetic polypeptide
DIQMTQSPSSLSASVGDRVTITCRASQLVSNAVAWYQQKPGKAPKLLIYWASTRHTGVPSRFSGSGSGTDFTLTISSLQPEDFATYYCQQHYSSPFTFGQGTKLEIK

SEQ ID NO: 735 - protein, 107 aa, Artificial Sequence
  Description of Artificial Sequence: Synthetic polypeptide
DIQMTQSPSSLSASVGDRVTITCRASQLVSSAVAWYQQKPGKAPKLLIYWASARHSGVPSRFSGSGSGTDFTLTISSLQPEDFATYYCQQHYSTPFTFGQGTKLEIK

SEQ ID NO: 736 - protein, 107 aa, Artificial Sequence
  Description of Artificial Sequence: Synthetic polypeptide
DIQMTQSPSSLSASVGDRVTITCKASQLVSSAVAWYQQKPGKAPKLLIYWASTRHSGVPSRFSGSGSGTDFTLTISSLQPEDFATYYCQQHYTTPFTFGQGTKLEIK

SEQ ID NO: 737 - protein, 107 aa, Artificial Sequence
  Description of Artificial Sequence: Synthetic polypeptide
DIQMTQSPSSLSASVGDRVTITCKASQRVSSAVAWYQQKPGKAPKLLIYWASTRHTGVPSRFSGSGSGTDFTLTISSLQPEDFATYYCQQHYSTPFTFGQGTKLEIK

SEQ ID NO: 738 - protein, 117 aa, Artificial Sequence; identical to SEQ ID NO: 34
  Description of Artificial Sequence: Synthetic polypeptide

SEQ ID NO: 739 - protein, 117 aa, Artificial Sequence; identical to SEQ ID NO: 35
  Description of Artificial Sequence: Synthetic polypeptide

SEQ ID NO: 740 - protein, 117 aa, Artificial Sequence; identical to SEQ ID NO: 36
  Description of Artificial Sequence: Synthetic polypeptide

SEQ ID NO: 741 - protein, 117 aa, Artificial Sequence; identical to SEQ ID NO: 37
  Description of Artificial Sequence: Synthetic polypeptide

SEQ ID NO: 742 - protein, 117 aa, Artificial Sequence; identical to SEQ ID NO: 38
  Description of Artificial Sequence: Synthetic polypeptide

SEQ ID NO: 743 - protein, 117 aa, Artificial Sequence; identical to SEQ ID NO: 39
  Description of Artificial Sequence: Synthetic polypeptide

SEQ ID NO: 744 - protein, 117 aa, Artificial Sequence; identical to SEQ ID NO: 40
  Description of Artificial Sequence: Synthetic polypeptide

SEQ ID NO: 745 - protein, 117 aa, Artificial Sequence; identical to SEQ ID NO: 41
  Description of Artificial Sequence: Synthetic polypeptide

SEQ ID NO: 746 - protein, 117 aa, Artificial Sequence; identical to SEQ ID NO: 42
  Description of Artificial Sequence: Synthetic polypeptide

SEQ ID NO: 747 - protein, 117 aa, Artificial Sequence; identical to SEQ ID NO: 43
  Description of Artificial Sequence: Synthetic polypeptide

SEQ ID NO: 748 - protein, 117 aa, Artificial Sequence; identical to SEQ ID NO: 44
  Description of Artificial Sequence: Synthetic polypeptide

SEQ ID NO: 749 - protein, 117 aa, Artificial Sequence; identical to SEQ ID NO: 45
  Description of Artificial Sequence: Synthetic polypeptide

SEQ ID NO: 750 - protein, 117 aa, Artificial Sequence; identical to SEQ ID NO: 46
  Description of Artificial Sequence: Synthetic polypeptide

SEQ ID NO: 751 - protein, 117 aa, Artificial Sequence; identical to SEQ ID NO: 46
  Description of Artificial Sequence: Synthetic polypeptide

SEQ ID NO: 752 - protein, 117 aa, Artificial Sequence; identical to SEQ ID NO: 48
  Description of Artificial Sequence: Synthetic polypeptide

SEQ ID NO: 753 - protein, 117 aa, Artificial Sequence; identical to SEQ ID NO: 44
  Description of Artificial Sequence: Synthetic polypeptide

SEQ ID NO: 754 - protein, 117 aa, Artificial Sequence; identical to SEQ ID NO: 38
  Description of Artificial Sequence: Synthetic polypeptide

SEQ ID NO: 755 - protein, 117 aa, Artificial Sequence; identical to SEQ ID NO: 51
  Description of Artificial Sequence: Synthetic polypeptide

SEQ ID NO: 756 - protein, 117 aa, Artificial Sequence; identical to SEQ ID NO: 52
  Description of Artificial Sequence: Synthetic polypeptide

SEQ ID NO: 757 - protein, 117 aa, Artificial Sequence; identical to SEQ ID NO: 53
  Description of Artificial Sequence: Synthetic polypeptide

SEQ ID NO: 758 - protein, 117 aa, Artificial Sequence; identical to SEQ ID NO: 44
  Description of Artificial Sequence: Synthetic polypeptide

SEQ ID NO: 759 - protein, 117 aa, Artificial Sequence; identical to SEQ ID NO: 44
  Description of Artificial Sequence: Synthetic polypeptide

SEQ ID NO: 760 - protein, 117 aa, Artificial Sequence; identical to SEQ ID NO: 44
  Description of Artificial Sequence: Synthetic polypeptide

SEQ ID NO: 761 - protein, 117 aa, Artificial Sequence; identical to SEQ ID NO: 44
  Description of Artificial Sequence: Synthetic polypeptide

SEQ ID NO: 762 - protein, 117 aa, Artificial Sequence; identical to SEQ ID NO: 44
  Description of Artificial Sequence: Synthetic polypeptide

SEQ ID NO: 763 - protein, 108 aa, Artificial Sequence; identical to SEQ ID NO: 59
  Description of Artificial Sequence: Synthetic polypeptide

SEQ ID NO: 764 - protein, 108 aa, Artificial Sequence; identical to SEQ ID NO: 60
  Description of Artificial Sequence: Synthetic polypeptide

SEQ ID NO: 765 - protein, 108 aa, Artificial Sequence; identical to SEQ ID NO: 61
  Description of Artificial Sequence: Synthetic polypeptide

SEQ ID NO: 766 - protein, 108 aa, Artificial Sequence; identical to SEQ ID NO: 62
  Description of Artificial Sequence: Synthetic polypeptide

SEQ ID NO: 767 - protein, 108 aa, Artificial Sequence; identical to SEQ ID NO: 63
  Description of Artificial Sequence: Synthetic polypeptide

SEQ ID NO: 768 - protein, 108 aa, Artificial Sequence; identical to SEQ ID NO: 64
  Description of Artificial Sequence: Synthetic polypeptide

SEQ ID NO: 769 - protein, 108 aa, Artificial Sequence; identical to SEQ ID NO: 65
  Description of Artificial Sequence: Synthetic polypeptide

SEQ ID NO: 770 - protein, 108 aa, Artificial Sequence; identical to SEQ ID NO: 66
  Description of Artificial Sequence: Synthetic polypeptide

SEQ ID NO: 771 - protein, 108 aa, Artificial Sequence; identical to SEQ ID NO: 67
  Description of Artificial Sequence: Synthetic polypeptide

SEQ ID NO: 772 - protein, 108 aa, Artificial Sequence; identical to SEQ ID NO: 68
  Description of Artificial Sequence: Synthetic polypeptide

SEQ ID NO: 773 - protein, 108 aa, Artificial Sequence; identical to SEQ ID NO: 69
  Description of Artificial Sequence: Synthetic polypeptide

SEQ ID NO: 774 - protein, 108 aa, Artificial Sequence; identical to SEQ ID NO: 70
  Description of Artificial Sequence: Synthetic polypeptide

SEQ ID NO: 775 - protein, 108 aa, Artificial Sequence; identical to SEQ ID NO: 71
  Description of Artificial Sequence: Synthetic polypeptide

SEQ ID NO: 776 - protein, 108 aa, Artificial Sequence; identical to SEQ ID NO: 72
  Description of Artificial Sequence: Synthetic polypeptide

SEQ ID NO: 777 - protein, 108 aa, Artificial Sequence; identical to SEQ ID NO: 70
  Description of Artificial Sequence: Synthetic polypeptide

SEQ ID NO: 778 - protein, 124 aa, Artificial Sequence
  Description of Artificial Sequence: Synthetic polypeptide
EVQLVQSGAEVKKPGASVKVSCKASGYTFNDYGITWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 779 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLTTVVVTDYAMDYWGQGTTVTVSS

SEQ ID NO: 780 - protein, 124 aa, Artificial Sequence
  Description of Artificial Sequence: Synthetic polypeptide
EVQLVQSGAEVKKPGASVKVSCKASGYTFTNYGISWVRQAPGQGLEWMGWINTYTGEPHYAQGLTGRVTMTTDTSTSTAYMELSSLRSEDTAVYFCARKFLTTVVVTDYAMDYWGQGTTVTVSS

SEQ ID NO: 781 - protein, 124 aa, Artificial Sequence
  Description of Artificial Sequence: Synthetic polypeptide
EVQLVQSGAEVKKPGASVKVSCKASGYTFDNYGIQWVRQAPGQGLEWMGWINTYTGAPSYAQGFTGRVTMTTDTSTSTAYMELSSLRSEDTAVYFCARKFLTTVVVTDYAMDYWGQGTTVTVSS

SEQ ID NO: 782 - protein, 124 aa, Artificial Sequence
  Description of Artificial Sequence: Synthetic polypeptide
EVQLVQSGAEVKKPGASVKVSCKASGYTFTDYGINWVRQAPGQGLEWMGWINTYTGKPSYAQGFTGRVTMTTDTSTSTAYMELSSLRSEDTAVYFCARKFLTTVVVTDYAMDYWGQGTTVTVSS

SEQ ID NO: 783 - protein, 124 aa, Artificial Sequence
  Description of Artificial Sequence: Synthetic polypeptide
EVQLVQSGAEVKKPGASVKVSCKASGYTFSNYGMNWVRQAPGQGLEWMGWINTYTGESTYAQGFTGRVTMTTDTSTSTAYMELSSLRSEDTAVYFCARKFLTTVVVTDYAMDYWGQGTTVTVSS

SEQ ID NO: 784 - protein, 124 aa, Artificial Sequence
  Description of Artificial Sequence: Synthetic polypeptide
EVQLVQSGAEVKKPGASVKVSCKASGYTFKNYGMTWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 785 - protein, 124 aa, Artificial Sequence
  Description of Artificial Sequence: Synthetic polypeptide
EVQLVQSGAEVKKPGASVKVSCKASGYAFTDYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 786 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGEPAYAQGFTGRVTMTTDTSTSTAYMELSSLRSEDTAVYFCARKFLTTVVVTDYAMDYWGQGTTVTVSS

SEQ ID NO: 787 - protein, 124 aa, Artificial Sequence
  Description of Artificial Sequence: Synthetic polypeptide
EVQLVQSGAEVKKPGASVKVSCKASGYTFRNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS

SEQ ID NO: 788 - protein, 124 aa, Artificial Sequence
  Description of Artificial Sequence: Synthetic polypeptide
EVQLVQSGAEVKKPGASVKVSCKASGYTFTDYGINWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 789 - protein, 124 aa, Artificial Sequence
  Description of Artificial Sequence: Synthetic polypeptide
EVQLVQSGAEVKKPGASVKVSCKASGYTFKNYGIIWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 790 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGVPTYAQGFTGRVTMTTDTSTSTAYMELSSLRSEDTAVYFCARKFLTTVVVTDYAMDYWGQGTTVTVSS

SEQ ID NO: 791 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGKPSYAQGFTGRVTMTTDTSTSTAYMELSSLRSEDTAVYFCARKFLTTVVVTDYAMDYWGQGTTVTVSS

SEQ ID NO: 792 - protein, 124 aa, Artificial Sequence
  Description of Artificial Sequence: Synthetic polypeptide
EVQLVQSGAEVKKPGASVKVSCKASGYTFKNYGINWVRQAPGQGLEWMGWINTYTGKPTYAQGLTGRVTMTTDTSTSTAYMELSSLRSEDTAVYFCARKFLTTVVVTDYAMDYWGQGTTVTVSS

SEQ ID NO: 793 - protein, 124 aa, Artificial Sequence
  Description of Artificial Sequence: Synthetic polypeptide
EVQLVQSGAEVKKPGASVKVSCKASGYTFRNYGINWVRQAPGQGLEWMGWINTYTGKPSYAQGFTGRVTMTTDTSTSTAYMELSSLRSEDTAVYFCARKFLTTVVVTDYAMDYWGQGTTVTVSS

SEQ ID NO: 794 - protein, 124 aa, Artificial Sequence
  Description of Artificial Sequence: Synthetic polypeptide
  MOD_RES (35)..(35): Any amino acid
  MOD_RES (55)..(55): Any amino acid
EVQLVQSGAEVKKPGASVKVSCKASGYTFTNYGIXWVRQAPGQGLEWMGWINTYXGKPTYAQGFTGRVTMTTDTSTSTAYMELSSLRSEDTAVYFCARKFLTTVVVTDYAMDYWGQGTTVTVSS

SEQ ID NO: 795 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGEPHYAQGLTGRVTMTTDTSTSTAYMELSSLRSEDTAVYFCARKFLTTVVVTDYAMDYWGQGTTVTVSS

SEQ ID NO: 796 - protein, 124 aa, Artificial Sequence
  Description of Artificial Sequence: Synthetic polypeptide
EVQLVQSGAEVKKPGASVKVSCKASGYTFTHYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 797 - protein, 124 aa, Artificial Sequence
  Description of Artificial Sequence: Synthetic polypeptide
EVQLVQSGAEVKKPGASVKVSCKASGYTFTHYGINWVRQAPGQGLEWMGWINTYTGQPTYAQGLTGRVTMTTDTSTSTAYMELSSLRSEDTAVYFCARKFLTTVVVTDYAMDYWGQGTTVTVSS

SEQ ID NO: 798 - protein, 124 aa, Artificial Sequence
  Description of Artificial Sequence: Synthetic polypeptide
EVQLVQSGAEVKKPGASVKVSCKASGYTFTNYGITWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 799 - protein, 124 aa, Artificial Sequence
  Description of Artificial Sequence: Synthetic polypeptide
EVQLVQSGAEVKKPGASVKVSCKASGYTFGNYGINWVRQAPGQGLEWMGWINTYTGKPSYAQGFTGRVTMTTDTSTSTAYMELSSLRSEDTAVYFCARKFLTTVVVTDYAMDYWGQGTTVTVSS

SEQ ID NO: 800 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGRPTYAQGFTGRVTMTTDTSTSTAYMELSSLRSEDTAVYFCARKFLTTVVVTDYAMDYWGQGTTVTVSS

SEQ ID NO: 801 - protein, 124 aa, Artificial Sequence
  Description of Artificial Sequence: Synthetic polypeptide
EVQLVQSGAEVKKPGASVKVSCKASGYTFKNYGINWVRQAPGQGLEWMGWINTYTGEPHYAQGFTGRVTMTTDTSTSTAYIELSSLRSEDTAVYFCARKFLTTVVVTDYAMDYWGQGTTVTVSS

SEQ ID NO: 802 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGEPSYAQGFTGRVTMTTDTSTSTAYMELSSLRSEDTAVYFCARKFLTTVVVTDYAMDYWGQGTTVTVSS

SEQ ID NO: 803 - protein, 124 aa, Artificial Sequence
  Description of Artificial Sequence: Synthetic polypeptide
EVQLVQSGAEVKKPGASVKVSCKASGYTFSNYGMNWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 804 - protein, 124 aa, Artificial Sequence
  Description of Artificial Sequence: Synthetic polypeptide
EVQLVQSGAEVKKPGASVKVSCKASGYTFTNYGIGWVRQAPGQGLEWMGWINTYTGKPSYAQGFTGRVTMTTDTSTSTAYMELSSLRSEDTAVYFCARKFLTTVVVTDYAMDYWGQGTTVTVSS

SEQ ID NO: 805 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGVPSYAQGFTGRVTMTTDTSTSTAYMELSSLRSEDTAVYFCARKFLTTVVVTDYAMDYWGQGTTVTVSS

SEQ ID NO: 806 - protein, 124 aa, Artificial Sequence
  Description of Artificial Sequence: Synthetic polypeptide
EVQLVQSGAEVKKPGASVKVSCKASGYTFSNYGIAWVRQAPGQGLEWMGWINTYTGVPTYAQGFTGRVTMTTDTSTSTAYMELSSLRSEDTAVYFCARKFLTTVVVTDYAMDYWGQGTTVTVSS

SEQ ID NO: 807 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGVPHYAQGFTGRVTMTTDTSTSTAYMELSSLRSEDTAVYFCARKFLTTVVVTDYAMDYWGQGTTVTVSS

SEQ ID NO: 808 - protein, 124 aa, Artificial Sequence
  Description of Artificial Sequence: Synthetic polypeptide
  MOD_RES (35)..(35): Any amino acid
  MOD_RES (59)..(59): Any amino acid
EVQLVQSGAEVKKPGASVKVSCKASGYTFTNYGIXWVRQAPGQGLEWMGWINTYTGEPXYAQGFTGRVTMTTDTSTSTAYMELSSLRSEDTAVYFCARKFLTTVVVTDYAMDYWGQGTTVTVSS

SEQ ID NO: 809 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGVPTYAQGLTGRVTMTTDTSTSTAYMELSSLRSEDTAVYFCARKFLTTVVVTDYAMDYWGQGTTVTVSS

SEQ ID NO: 810 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS

SEQ ID NO: 811 - protein, 124 aa, Artificial Sequence
  Description of Artificial Sequence: Synthetic polypeptide
EVQLVQSGAEVKKPGASVKVSCKASGYTFTDYGITWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 812 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGVPQYAQGFTGRVTMTTDTSTSTAYMELSSLRSEDTAVYFCARKFLTTVVVTDYAMDYWGQGTTVTVSS

SEQ ID NO: 813 - protein, 124 aa, Artificial Sequence
  Description of Artificial Sequence: Synthetic polypeptide
EVQLVQSGAEVKKPGASVKVSCKASGYTFQNYGINWVRQAPGQGLEWMGWINTYTGVPTYAQGLTGRVTMTTDTSTSTAYMELSSLRSEDTAVYFCARKFLTTVVVTDYAMDYWGQGTTVTVSS

SEQ ID NO: 814 - protein, 124 aa, Artificial Sequence
  Description of Artificial Sequence: Synthetic polypeptide
EVQLVQSGAEVKKPGASVKVSCKASGYTFTQYGINWVRQAPGQGLEWMGWINTYTGDPHYAQGFTGRVTMTTDTSTSTAYMELSSLRSEDTAVYFCARKFLTTVVVTDYAMDYWGQGTTVTVSS

SEQ ID NO: 815 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGLPTYAQGFTGRVTMTTDTSTSTAYMELSSLRSEDTAVYFCARKFLTTVVVTDYAMDYWGQGTTVTVSS

SEQ ID NO: 816 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYNGKPMYAQGFTGRVTMTTDTSTSTAYMELSSLRSEDTAVYFCARKFLTTVVVTDYAMDYWGQGTTVTVSS

SEQ ID NO: 817 - protein, 124 aa, Artificial Sequence
  Description of Artificial Sequence: Synthetic polypeptide
EVQLVQSGAEVKKPGASVKVSCKASGYTFRNYGITWVRQAPGQGLEWMGWINTYTGEPAYAQGLTGRVTMTTDTSTSTAYMELSSLRSEDTAVYFCARKFLTTVVVTDYAMDYWGQGTTVTVSS

SEQ ID NO: 818 - protein, 124 aa, Artificial Sequence
  Description of Artificial Sequence: Synthetic polypeptide
EVQLVQSGAEVKKPGASVKVSCKASGYTFNHYGINWVRQAPGQGLEWMGWINTYTGRPTYAQGFTGRVTMTTDTSTSTAYMELSSLRSEDTAVYFCARKFLTTVVVTDYAMDYWGQGTTVTVSS

SEQ ID NO: 819 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGKPTYAQGLTGRVTMTTDTSTSTAYMELSSLRSEDTAVYFCARKFLTTVVVTDYAMDYWGQGTTVTVSS

SEQ ID NO: 820 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 821 - protein, 124 aa, Artificial Sequence
  Description of Artificial Sequence: Synthetic polypeptide
EVQLVQSGAEVKKPGASVKVSCKASGYTFDNYGINWVRQAPGQGLEWMGWINTYTGVPTYAQGFTGRVTMTTDTSTSTAYMELSSLRSEDTAVYFCARKFLTTVVVTDYAMDYWGQGTTVTVSS

SEQ ID NO: 822 - protein, 124 aa, Artificial Sequence
  Description of Artificial Sequence: Synthetic polypeptide
EVQLVQSGAEVKKPGASVKVSCKASGYTFNDYGIIWVRQAPGQGLEWMGWINTYTGKPSYAQGFTGRVTMTTDTSTSTAYMELSSLRSEDTAVYFCARKFLTTVVVTDYAMDYWGQGTTVTVSS

SEQ ID NO: 823 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 824 - protein, 124 aa, Artificial Sequence
  Description of Artificial Sequence: Synthetic polypeptide
EVQLVQSGAEVKKPGASVKVSCKASGYTFANYGMNWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 825 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGEPSYAQGLTGRVTMTTDTSTSTAYMELSSLRSEDTAVYFCARKFLTTVVVTDYAMDYWGQGTTVTVSS

SEQ ID NO: 826 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGVPTYAQGLTGRVTMTTDTSTSTAYMELSSLRSEDTAVYFCARKFLTTVVVTDYAMDYWGQGTTVTVSS

SEQ ID NO: 827 - protein, 124 aa, Artificial Sequence
  Description of Artificial Sequence: Synthetic polypeptide
EVQLVQSGAEVKKPGASVKVSCKASGYTFDHYGMNWVRQAPGQGLEWMGWINTYTGKPTYAQGLTGRVTMTTDTSTSTAYMELSSLRSEDTAVYFCARKFLTTVVVTDYAMDYWGQGTTVTVSS

SEQ ID NO: 828 - protein, 124 aa, Artificial Sequence
  Description of Artificial Sequence: Synthetic polypeptide
EVQLVQSGAEVKKPGASVKVSCKASGYTFTNYGIGWVRQAPGQGLEWMGWINTYTGKPSYAQGLTGRVTMTTDTSTSTAYMELSSLRSEDTAVYFCARKFLTTVVVTDYAMDYWGQGTTVTVSS

SEQ ID NO: 829 - protein, 124 aa, Artificial Sequence; identical to SEQ ID NO: 779
  Description of Artificial Sequence: Synthetic polypeptide

SEQ ID NO: 830 - protein, 124 aa, Artificial Sequence
  Description of Artificial Sequence: Synthetic polypeptide
EVQLVQSGAEVKKPGASVKVSCKASGYTFNNYGMNWVRQAPGQGLEWMGWINTYTGKPTYAQGLTGRVTMTTDTSTSTAYMELSSLRSEDTAVYFCARKFLTTVVVTDYAMDYWGQGTTVTVSS

SEQ ID NO: 831 - protein, 124 aa, Artificial Sequence
  Description of Artificial Sequence: Synthetic polypeptide
EVQLVQSGAEVKKPGASVKVSCKASGYTFDNYGMNWVRQAPGQGLEWMGWINTYTGVPTYAQGFTGRVTMTTDTSTSTAYMELSSLRSEDTAVYFCARKFLTTVVVTDYAMDYWGQGTTVTVSS

SEQ ID NO: 832 - protein, 124 aa, Artificial Sequence
  Description of Artificial Sequence: Synthetic polypeptide
EVQLVQSGAEVKKPGASVKVSCKASGYTFNSYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 833 - protein, 124 aa, Artificial Sequence
  Description of Artificial Sequence: Synthetic polypeptide
EVQLVQSGAEVKKPGASVKVSCKASGYTFSNYGITWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 834 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYNGQPTYAQGFTGRVTMTTDTSTSTAYMELSSLRSEDTAVYFCARKFLTTVVVTDYAMDYWGQGTTVTVSS

SEQ ID NO: 835 - protein, 124 aa, Artificial Sequence
  Description of Artificial Sequence: Synthetic polypeptide
EVQLVQSGAEVKKPGASVKVSCKASGYTFTNYGIIWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 836 - protein, 124 aa, Artificial Sequence
  Description of Artificial Sequence: Synthetic polypeptide
EVQLVQSGAEVKKPGASVKVSCKASGYTFANYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 837 - protein, 124 aa, Artificial Sequence
  Description of Artificial Sequence: Synthetic polypeptide
EVQLVQSGAEVKKPGASVKVSCKASGYTFSDYGIQWVRQAPGQGLEWMGWINTYTGRPTYAQGFTGRVTMTTDTSTSTAYMELSSLRSEDTAVYFCARKFLTTVVVTDYAMDYWGQGTTVTVSS

SEQ ID NO: 838 - protein, 124 aa, Artificial Sequence
  Description of Artificial Sequence: Synthetic polypeptide
EVQLVQSGAEVKKPGASVKVSCKASGYTFSNYGISWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 839 - protein, 124 aa, Artificial Sequence
  Description of Artificial Sequence: Synthetic polypeptide
EVQLVQSGAEVKKPGASVKVSCKASGYTFTNYGIQWVRQAPGQGLEWMGWINTYTGVPTYAQGFTGRVTMTTDTSTSTAYMELSSLRSEDTAVYFCARKFLTTVVVTDYAMDYWGQGTTVTVSS

SEQ ID NO: 840 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGVPTYAQGFTGRVTMTTDTSTSTAYMELSSLRSEDTAVYFCARKFLTTVVVTDYAMDYWGQGTTVTVSS

SEQ ID NO: 841 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYSGKPTYAQGFTGRVTMTTDTSTSTAYMELSSLRSEDTAVYFCARKFLTTVVVTDYAMDYWGQGTTVTVSS

SEQ ID NO: 842 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS

SEQ ID NO: 843 - protein, 124 aa, Artificial Sequence
  Description of Artificial Sequence: Synthetic polypeptide
EVQLVQSGAEVKKPGASVKVSCKASGYTFPNYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 844 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGKTNYAQGFTGRVTMTTDTSTSTAYMELSSLRSEDTAVYFCARKFLTTVVVTDYAMDYWGQGTTVTVSS

SEQ ID NO: 845 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGEPNYAQGFTGRVTMTTDTSTSTAYMELSSLRSEDTAVYFCARKFLTTVVVTDYAMDYWGQGTTVTVSS

SEQ ID NO: 846 - protein, 124 aa, Artificial Sequence
  Description of Artificial Sequence: Synthetic polypeptide
EVQLVQSGAEVKKPGASVKVSCKASGYTFSNYGITWVRQAPGQGLEWMGWINTYTGEPHYAQGLTGRVTMTTDTSTSTAYMELSSLRSEDTAVYFCARKFLTTVVVTDYAMDYWGQGTTVTVSS

SEQ ID NO: 847 - protein, 124 aa, Artificial Sequence
  Description of Artificial Sequence: Synthetic polypeptide
EVQLVQSGAEVKKPGASVKVSCKASGYTFKNYGINWVRQAPGQGLEWMGWINTYTGQPTYAQGFTGRVTMTTDTSTSTAYMELSSLRSEDTAVYFCARKFLTTVVVTDYAMDYWGQGTTVTVSS

SEQ ID NO: 848 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGIPTYAQGFTGRVTMTTDTSTSTAYMELSSLRSEDTAVYFCARKFLTTVVVTDYAMDYWGQGTTVTVSS

SEQ ID NO: 849 - protein, 124 aa, Artificial Sequence
  Description of Artificial Sequence: Synthetic polypeptide
EVQLVQSGAEVKKPGASVKVSCKASGYTFTDYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 850 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYSGVPTYAQGFTGRVTMTTDTSTSTAYMELSSLRSEDTAVYFCARKFLTTVVVTDYAMDYWGQGTTVTVSS

SEQ ID NO: 851 - protein, 124 aa, Artificial Sequence; identical to SEQ ID NO: 849
  Description of Artificial Sequence: Synthetic polypeptide

SEQ ID NO: 852 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFWRTVVGTDNAMDYWGQGTTVTVSS

SEQ ID NO: 853 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYSTTVVVTDYAMDYWGQGTTVTVSS

SEQ ID NO: 854 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLTTVVVTDSAMDYWGQGTTVTVSS

SEQ ID NO: 855 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFMTTMAVTDFAMDYWGQGTTVTVSS

SEQ ID NO: 856 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLTTVVATDNAMDYWGQGTTVTVSS

SEQ ID NO: 857 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVIVTDNAMDYWGQGTTVTVSS

SEQ ID NO: 858 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFFTPVVVTDNAMDYWGQGTTVTVSS

SEQ ID NO: 859 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLMTTVVVTDHAMDYWGQGTTVTVSS

SEQ ID NO: 860 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKYLTTVVVTDSAMDYWGQGTTVTVSS

SEQ ID NO: 861 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFRSSVAVTDNAMDYWGQGTTVTVSS

SEQ ID NO: 862 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLFTTVVVTDSAMDYWGQGTTVTVSS

SEQ ID NO: 863 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYLMPVVVTDYAMDYWGQGTTVTVSS

SEQ ID NO: 864 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLDAVMVTDYAMDYWGQGTTVTVSS

SEQ ID NO: 865 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVVNDYAMDYWGQGTTVTVSS

SEQ ID NO: 866 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLTTVAVTDYAMDYWGQGTTVTVSS

SEQ ID NO: 867 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLKTVVATDDAMDYWGQGTTVTVSS

SEQ ID NO: 868 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLNTAVVTDYAMDYWGQGTTVTVSS

SEQ ID NO: 869 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARRFLTTVDVTDNAMDYWGQGTTVTVSS

SEQ ID NO: 870 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYLTPVVATDFAMDYWGQGTTVTVSS

SEQ ID NO: 871 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKCMTTIVETDNAMDYWGQGTTVTVSS

SEQ ID NO: 872 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFMNTVDVTDNAMDYWGQGTTVTVSS

SEQ ID NO: 873 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLFTTVVVTDDAMDYWGQGTTVTVSS

SEQ ID NO: 874 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLMTTVVVTDYAMDYWGQGTTVTVSS

SEQ ID NO: 875 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLPTVVVTDYAMDYWGQGTTVTVSS

SEQ ID NO: 876 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLTTVVVTDNAMDYWGQGTTVTVSS

SEQ ID NO: 877 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKILTTVVVTDNAMDYWGQGTTVTVSS

SEQ ID NO: 878 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKVMATEVVTDYAMDYWGQGTTVTVSS

SEQ ID NO: 879 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLVTTVVVTDYAMDYWGQGTTVTVSS

SEQ ID NO: 880 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFRKPVSVTDYAMDYWGQGTTVTVSS

SEQ ID NO: 881 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLWTTVVVTDNAMDYWGQGTTVTVSS

SEQ ID NO: 882 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLTPVVVTDYAMDYWGQGTTVTVSS

SEQ ID NO: 883 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFRTTVVETDYCMDYWGQGTTVTVSS

SEQ ID NO: 884 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYFTTVAVTDYAMDYWGQGTTVTVSS

SEQ ID NO: 885 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARRFLTTVEVTDLAMDYWGQGTTVTVSS

SEQ ID NO: 886 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLRTEVMTDYAMDYWGQGTTVTVSS

SEQ ID NO: 887 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLSTVAVTDSAMDYWGQGTTVTVSS

SEQ ID NO: 888 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKVLNTVVVTDYAMDYWGQGTTVTVSS

SEQ ID NO: 889 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFMNTAMVTDYAMDYWGQGTTVTVSS

SEQ ID NO: 890 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFSTTVVVTDYAMDYWGQGTTVTVSS

SEQ ID NO: 891 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYFTTVVVTDYAMDYWGQGTTVTVSS

SEQ ID NO: 892 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLNTVVVTDYAMDYWGQGTTVTVSS

SEQ ID NO: 893 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFMPTVVETDYAMDYWGQGTTVTVSS

SEQ ID NO: 894 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGNPTYAQGFTGRVTMTTDTSTSTAYMELSSLRSEDTAVYFCARKFLTTVVVTDYAMDYWGQGTTVTVSS

SEQ ID NO: 895 - protein, 124 aa, Artificial Sequence
  Description of Artificial Sequence: Synthetic polypeptide
EVQLVQSGAEVKKPGASVKVSCKASGYTFADYGMNWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 896 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVVTDCAMDYWGQGTTVTVSS

SEQ ID NO: 897 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 898 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVVTDNAMDYWGQGTTVTVSS

SEQ ID NO: 899 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLNTVVGTDYAMDYWGQGTTVTVSS

SEQ ID NO: 900 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLTTEAVTDYAMDYWGQGTTVTVSS

SEQ ID NO: 901 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKYSTPVVVTDYAMDYWGQGTTVTVSS

SEQ ID NO: 902 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGEPTYAQGLTGRVTMTTDTSTSTAYMELSSLRSEDTAVYFCARKFLTTVVVTDYAMDYWGQGTTVTVSS

SEQ ID NO: 903 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKCLNTVAVTEHRMDYWGQGTTVTVSS

SEQ ID NO: 904 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVHTDYAMDYWGQGTTVTVSS

SEQ ID NO: 905 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGQPTYAQGFTGRVTMTTDTSTSTAYMELSSLRSEDTAVYFCARKFLTTVVVTDYAMDYWGQGTTVTVSS

SEQ ID NO: 906 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGKPTYAQGFTGRVTMTTDTSTSTAYMELSSLRSEDTAVYFCARKFLTTVVVTDYAMDYWGQGTTVTVSS

SEQ ID NO: 907 - protein, 124 aa, Artificial Sequence
  Description of Artificial Sequence: Synthetic polypeptide
EVQLVQSGAEVKKPGASVKVSCKASGYTFANYGINWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 908 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFRTTVVLTDSAMDYWGQGTTVTVSS

SEQ ID NO: 909 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGEPTYAQGLTGRVTMTTDTSTSTAYMELSSLRSEDTAVYFCARKFLTTVVVTDYAMDYWGQGTTVTVSS

SEQ ID NO: 910 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFQTPVVDTDYAMDYWGQGTTVTVSS

SEQ ID NO: 911 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFMKTRVVTDNAMDYWGQGTTVTVSS

SEQ ID NO: 912 - protein, 124 aa, Artificial Sequence
  Description of Artificial Sequence: Synthetic polypeptide
EVQLVQSGAEVKKPGASVKVSCKASGYTFSNYGIVWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 913 - protein, 124 aa, Artificial Sequence
  Description of Artificial Sequence: Synthetic polypeptide
EVQLVQSGAEVKKPGASVKVSCKASGYTFPNYGISWVRQAPGQGLEWMGWINTYTGEPSYAQGFTGRVTMTTDTSTSTAYMELSSLRSEDTAVYFCARKFLTTVVVTDYAMDYWGQGTTVTVSS

SEQ ID NO: 914 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGEPSYAQGLTGRVTMTTDTSTSTAYMELSSLRSEDTAVYFCARKFLTTVVVTDYAMDYWGQGTTVTVSS

SEQ ID NO: 915 - protein, 124 aa, Artificial Sequence
  Description of Artificial Sequence: Synthetic polypeptide
EVQLVQSGAEVKKPGASVKVSCKASGYTFTKYGINWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 916 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKYLTTVVATDYAMDYWGQGTTVTVSS

SEQ ID NO: 917 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLNTVVVTDYAMDYWGQGTTVTVSS

SEQ ID NO: 918 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTPVVVTDCAMDYWGQGTTVTVSS

SEQ ID NO: 919 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGEPRYAQGLTGRVTMTTDTSTSTAYMELSSLRSEDTAVYFCARKFLTTVVVTDYAMDYWGQGTTVTVSS

SEQ ID NO: 920 - protein, 124 aa, Artificial Sequence
  Description of Artificial Sequence: Synthetic polypeptide
EVQLVQSGAEVKKPGASVKVSCKASGYTFRDYGINWVRQAPGQGLEWMGWINTYTGLPTYAQGFTGRVTMTTDTSTSTAYMELSSLRSEDTAVYFCARKFLTTVVVTDYAMDYWGQGTTVTVSS

SEQ ID NO: 921 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFWTTIVVTDYAMDYWGQGTTVTVSS

SEQ ID NO: 922 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLTTVSATDNAMDYWGQGTTVTVSS

SEQ ID NO: 923 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLNTVVVTDYAMDYWGQGTTVTVSS

SEQ ID NO: 924 - protein, 124 aa, Artificial Sequence
  Description of Artificial Sequence: Synthetic polypeptide
EVQLVQSGAEVKKPGASVKVSCKASGYTFTDYGINWVRQAPGQGLEWMGWINTYNGEPSYAQGLTGRVTMTTDTSTSTAYMELSSLRSEDTAVYFCARKFLTTVVVTDYAMDYWGQGTTVTVSS

SEQ ID NO: 925 - protein, 124 aa, Artificial Sequence
  Description of Artificial Sequence: Synthetic polypeptide
EVQLVQSGAEVKKPGASVKVSCKASGYTFATYGIAWVRQAPGQGLEWMGWINTYSGVPKYAQGLTGRVTMTTDTSTSTAYMELSSLRSEDTAVYFCARKFLTTVVVTDYAMDYWGQGTTVTVSS

SEQ ID NO: 926 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFRTTAVPTDNAMDYWGQGTTVTVSS

SEQ ID NO: 927 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFLTTVVNTDSAMDYWGQGTTVTVSS

SEQ ID NO: 928 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKFLTTVVVTDYAMDYWGRGTTVTVSS

SEQ ID NO: 929 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLKTRVVTDYAMDYWGQGTTVTVSS

SEQ ID NO: 930 - protein, 124 aa, Artificial Sequence; identical to SEQ ID NO: 779
  Description of Artificial Sequence: Synthetic polypeptide

SEQ ID NO: 931 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLTTVVATDYAMDYWGQGTTVTVSS

SEQ ID NO: 932 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGEPTYAQGFTGRVTMTTDTSTSTAYMELSSLRSEDTAVYFCARKFLTTVVVTDYAMDYWGQGTTVTVSS

SEQ ID NO: 933 - protein, 124 aa, Artificial Sequence; identical to SEQ ID NO: 810
  Description of Artificial Sequence: Synthetic polypeptide

SEQ ID NO: 934 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFFPTMVVTDYAMDYWGQGTTVTVSS

SEQ ID NO: 935 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKFVTTMVVTDYAMDYWGQGTTVTVSS

SEQ ID NO: 936 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYAQGLTGRVTMTTDTSTSTAYMELSSLRSEDTAVYFCARKFLTTVVVTDYAMDYWGQGTTVTVSS

SEQ ID NO: 937 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYFCARKLLTTIVATDNAMDYWGQGTTVTVSS

SEQ ID NO: 938 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLMSTVVETDNAMDYWGQGTTVTVSS

SEQ ID NO: 939 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLFTVVQTDYAMDYWGQGTTVTVSS

SEQ ID NO: 940 - protein, 124 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGEPTYADDFKGRFTFTLDTSTSTAYMELSSLRSEDTAVYYCARKLLNTVVDTDYAMDYWGQGTTVTVSS

SEQ ID NO: 941 - protein, 124 aa, Artificial Sequence
  Description of Artificial Sequence: Synthetic polypeptide
EVQLVQSGAEVKKPGASVKVSCKASGYTFSNYGIIWVRQAPGQGLEWMGWINTYTGEPHYAQKLQGRVTMTTDTSTSTAYMELSSLRSEDTAVYFCARKLFTVEDVTDCAMDYWGQGTTVTVSS

SEQ ID NO: 942 - protein, 124 aa, Artificial Sequence
  Description of Artificial Sequence: Synthetic polypeptide
EVQLVQSGAEVKKPGASVKVSCKASGYTFDNYGMNWVRQAPGQGLEWMGWINTYNGKPTYAQKFQGRVTMTTDTSTSTAYMELSSLRSEDTAVYFCARKLFLVEAVTDYAMDYWGQGTTVTVSS

SEQ ID NO: 943 - protein, 124 aa, Artificial Sequence; identical to SEQ ID NO: 78
  Description of Artificial Sequence: Synthetic polypeptide

SEQ ID NO: 944 - protein, 124 aa, Artificial Sequence; identical to SEQ ID NO: 76
  Description of Artificial Sequence: Synthetic polypeptide

SEQ ID NO: 945 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGEPHYAQKFQGRVTMTTDTSTSTAYMELSSLRSEDTAVYYCARKLFKTMAVTDAAMDYWGQGTTVTVSS

SEQ ID NO: 946 - protein, 124 aa, Artificial Sequence; identical to SEQ ID NO: 79
  Description of Artificial Sequence: Synthetic polypeptide

SEQ ID NO: 947 - protein, 124 aa, Artificial Sequence; identical to SEQ ID NO: 77
  Description of Artificial Sequence: Synthetic polypeptide

SEQ ID NO: 948 - protein, 124 aa, Artificial Sequence
  Description of Artificial Sequence: Synthetic polypeptide
EVQLVQSGAEVKKPGASVKVSCKASGYTFTNYGINWVRQAPGQGLEWMGWINTYTGKPTYAQKFQGRVTMTTDTSTSTAYMELSSLRSEDTAVYYCARKLFFTEDVTDYAMDYWGQGTTVTVSS

SEQ ID NO: 949 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFFTPVVVTDNAMDYWGQGTTVTVSS

SEQ ID NO: 950 - protein, 124 aa, Artificial Sequence; identical to SEQ ID NO: 80
  Description of Artificial Sequence: Synthetic polypeptide

SEQ ID NO: 951 - protein, 124 aa, Artificial Sequence; identical to SEQ ID NO: 74
  Description of Artificial Sequence: Synthetic polypeptide

SEQ ID NO: 952 - protein, 124 aa, Artificial Sequence; identical to SEQ ID NO: 75
  Description of Artificial Sequence: Synthetic polypeptide

SEQ ID NO: 953 - protein, 124 aa, Artificial Sequence
  Description of Artificial Sequence: Synthetic polypeptide
EVQLVQSGAEVKKPGASVKVSCKASGYTFSNYGIIWVRQAPGQGLEWMGWINTYTGKPSYAQKFQGRVTMTTDTSTSTAYMELSSLRSEDTAVYYCARKLFNTVDVTDNAMDYWGQGTTVTVSS

SEQ ID NO: 954 - protein, 124 aa, Artificial Sequence; identical to SEQ ID NO: 82
  Description of Artificial Sequence: Synthetic polypeptide

SEQ ID NO: 955 - protein, 124 aa, Artificial Sequence; identical to SEQ ID NO: 83
  Description of Artificial Sequence: Synthetic polypeptide

SEQ ID NO: 956 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKFFTTMAVTDNAMDYWGQGTTVTVSS

SEQ ID NO: 957 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIK

SEQ ID NO: 958 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYASRLQSGVPSRFSGSGSGTDYTLTISSLQPEDFATYFCQQGNTLPPTFGQGTKLEIK

SEQ ID NO: 959 - protein, 107 aa, Artificial Sequence
  Description of Artificial Sequence: Synthetic polypeptide
DIQMTQSPSSLSASVGDRVTITCRASQDISNYLNWYQQKPGKTVKLLIYYTSRLQSGVPSRFSGSGSGTDYTLTISSLQPEDFATYFCQQGNTLPPTFGQGTKLEIK

SEQ ID NO: 960 - protein, 107 aa, Artificial Sequence
  Description of Artificial Sequence: Synthetic polypeptide
DIQMTQSPSSLSASVGDRVTITCRASQDIWNYLNWYQQKPGKAPKLLIYYTSRLQSGVPSRFSGSGSGTDFTLTISSLQPEDFATYFCQQGNRYPPTFGQGTKLEIK

SEQ ID NO: 961 - protein, 107 aa, Artificial Sequence
  Description of Artificial Sequence: Synthetic polypeptide
DIQMTQSPSSLSASVGDRVTITCRASQDICTYLNWYQQKPGKAPKLLIYYTSRLQSGVPSRFSGSGSGTDFTLTISSLQPEDFATYYCQQGNSPPPTFGQGTKLEIK

SEQ ID NO: 962 - protein, 107 aa, Artificial Sequence
  Description of Artificial Sequence: Synthetic polypeptide
DIQMTQSPSSLSASVGDRVTITCRASQAIGNYLNWYQQKPGKAPKLLIYYASRLQSGVPSRFSGSGSGTDFTLTISSLQPEDFATYFCQQGNTLPPTFGQGTKLEIK

SEQ ID NO: 963 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTRPPTFGQGTKLEIK

SEQ ID NO: 964 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSLLQSGVPSRFSGSGSGTDYTLTISSLQPEDFATYYCQQGNTGPPTFGQGTKLEIK

SEQ ID NO: 965 - protein, 107 aa, Artificial Sequence
  Description of Artificial Sequence: Synthetic polypeptide
DIQMTQSPSSLSASVGDRVTITCRASQDIYNYLNWYQQKPGKAPKLLIYYTSRLQSGVPSRFSGSGSGTDYTLTISSLQPEDFATYFCQQGNTLPPTFGQGTKLEIK

SEQ ID NO: 966 - protein, 107 aa, Artificial Sequence
  Description of Artificial Sequence: Synthetic polypeptide
DIQMTQSPSSLSASVGDRVTITCRASQDISHYLNWYQQKPGKAPKLLIYYTSRLQSGVPSRFSGSGSGTDYTLTISSLQPEDFATYFCQQGNTLPATFGQGTKLEIK

SEQ ID NO: 967 - protein, 107 aa, Artificial Sequence
  Description of Artificial Sequence: Synthetic polypeptide
DIQMTQSPSSLSASVGDRVTITCRASQDISSYLNWYQQKPGKTVKLLIYYASRLQSGVPSRFSGSGSGTDFTLTISSLQPEDFATYYCQQGNTPPPTFGQGTKLEIK

SEQ ID NO: 968 - protein, 107 aa, Artificial Sequence
  Description of Artificial Sequence: Synthetic polypeptide
DIQMTQSPSSLSASVGDRVTITCRASQDISSYLNWYQQKPGKAPKLLIYYASRLQSGVPSRFSGSGSGTDFTLTISSLQPEDFATYYCQQGNTLPPTFGQGTKLEIK

SEQ ID NO: 969 - protein, 107 aa, Artificial Sequence
  Description of Artificial Sequence: Synthetic polypeptide
DIQMTQSPSSLSASVGDRVTITCRASQEISNYLNWYQQKPGKAPKLLIYYTSRLQSGVPSRFSGSGSGTDYTLTISSLQPEDFATYFCQQGNTMPTTFGQGTKLEIK

SEQ ID NO: 970 - protein, 107 aa, Artificial Sequence
  Description of Artificial Sequence: Synthetic polypeptide
DIQMTQSPSSLSASVGDRVTITCRASQDISNYLNWYQQKPGKAPKLLIYFASRLQSGVPSRFSGSGSGTDYTLTISSLQPEDFATYFCQQGNTPPTTFGQGTKLEIK

SEQ ID NO: 971 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTLPSTFGQGTKLEIK

SEQ ID NO: 972 - protein, 107 aa, Artificial Sequence
  Description of Artificial Sequence: Synthetic polypeptide
DIQMTQSPSSLSASVGDRVTITCRASQVISNTLNWYQQKPGKAPKLLIYYTSRLQSGVPSRFSGSGSGTDYTLTISSLQPEDFATYFCQQGNALPPTFGQGTKLEIK

SEQ ID NO: 973 - protein, 107 aa, Artificial Sequence
  Description of Artificial Sequence: Synthetic polypeptide
DIQMTQSPSSLSASVGDRVTITCRASQDISTYLNWYQQKPGKAPKLLIYYTSRLQSGVPSRFSGSGSGTDFTLTISSLQPEDFATYFCQQGNTPPPTFGQGTKLEIK

SEQ ID NO: 974 - protein, 107 aa, Artificial Sequence
  Description of Artificial Sequence: Synthetic polypeptide
DIQMTQSPSSLSASVGDRVTITCRASQDISQYLNWYQQKPGKAPKLLIYYTSRLQSGVPSRFSGSGSGTDYTLTISSLQPEDFATYYCQQGNTLPPTFGQGTKLEIK

SEQ ID NO: 975 - protein, 107 aa, Artificial Sequence
  Description of Artificial Sequence: Synthetic polypeptide
DIQMTQSPSSLSASVGDRVTITCRASQDITNYLNWYQQKPGKAPKLLIYYTSRLQSGVPSRFSGSGSGTDFTLTISSLQPEDFATYYCQQGNTAPPTFGQGTKLEIK

SEQ ID NO: 976 - protein, 107 aa, Artificial Sequence
  Description of Artificial Sequence: Synthetic polypeptide
DIQMTQSPSSLSASVGDRVTITCRASQGISNYLNWYQQKPGKAPKLLIYYTSRLQSGVPSRFSGSGSGTDYTLTISSLQPEDFATYFCQQGNTMPPTFGQGTKLEIK

SEQ ID NO: 977 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYFCQQGNTLPPTFGQGTKLEIK

SEQ ID NO: 978 - protein, 107 aa, Artificial Sequence
  Description of Artificial Sequence: Synthetic polypeptide
DIQMTQSPSSLSASVGDRVTITCRASQDISKYLNWYQQKPGKAPKLLIYYTSRLQSGVPSRFSGSGSGTDFTLTISSLQPEDFATYYCQQGNTRPPTFGQGTKLEIK

SEQ ID NO: 979 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSLLQSGVPSRFSGSGSGTDFTLTISSLQPEDFATYYCQQGNTQPPTFGQGTKLEIK

SEQ ID NO: 980 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYYCQQGNSQPPTFGQGTKLEIK

SEQ ID NO: 981 - protein, 107 aa, Artificial Sequence
  Description of Artificial Sequence: Synthetic polypeptide
DIQMTQSPSSLSASVGDRVTITCRASQDISKYLNWYQQKPGKAPKLLIYNASRLQSGVPSRFSGSGSGTDFTLTISSLQPEDFATYFCQQGNTLPPTFGQGTKLEIK

SEQ ID NO: 982 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSLLQSGVPSRFSGSGSGTDFTLTISSLQPEDFATYYCQQGNIWPPTFGQGTKLEIK

SEQ ID NO: 983 - protein, 107 aa, Artificial Sequence
  Description of Artificial Sequence: Synthetic polypeptide
DIQMTQSPSSLSASVGDRVTITCRASQDISHYLNWYQQKPGKAPKLLIYYTSRLQSGVPSRFSGSGSGTDYTLTISSLQPEDFATYFCQQGNTLPPTFGQGTKLEIK

SEQ ID NO: 984 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYYCQQGNTFPPTFGQGTKLEIK

SEQ ID NO: 985 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTQPPTFGQGTKLEIK

SEQ ID NO: 986 - protein, 107 aa, Artificial Sequence
  Description of Artificial Sequence: Synthetic polypeptide
DIQMTQSPSSLSASVGDRVTITCRASQDISNVLNWYQQKPGKAPKLLIYYASRLQSGVPSRFSGSGSGTDFTLTISSLQPEDFATYYCQQGNTLPPTFGQGTKLEIK

SEQ ID NO: 987 - protein, 107 aa, Artificial Sequence
  Description of Artificial Sequence: Synthetic polypeptide
DIQMTQSPSSLSASVGDRVTITCRASQDIYKYLNWYQQKPGKAPKLLIYYTSRLQSGVPSRFSGSGSGTDFTLTISSLQPEDFATYYCQQGNTMPPTFGQGTKLEIK

SEQ ID NO: 988 - protein, 107 aa, Artificial Sequence
  Description of Artificial Sequence: Synthetic polypeptide
DIQMTQSPSSLSASVGDRVTITCRASQEIFSYLNWYQQKPGKAPKLLIYYTSRLQSGVPSRFSGSGSGTDFTLTISSLQPEDFATYYCQQGNMGPPTFGQGTKLEIK

SEQ ID NO: 989 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYYCQQGNTQPPTFGQGTKLEIK

SEQ ID NO: 990 - protein, 107 aa, Artificial Sequence
  Description of Artificial Sequence: Synthetic polypeptide
DIQMTQSPSSLSASVGDRVTITCRASQDISSYLNWYQQKPGKAPKLLIYYASRLQSGVPSRFSGSGSGTDFTLTISSLQPEDFATYYCQQGNTWPPTFGQGTKLEIK

SEQ ID NO: 991 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYYCQQGNTRPPTFGQGTKLEIK

SEQ ID NO: 992 - protein, 107 aa, Artificial Sequence
  Description of Artificial Sequence: Synthetic polypeptide
DIQMTQSPSSLSASVGDRVTITCRASQDISNFLNWYQQKPGKAPKLLIYYASRLQSGVPSRFSGSGSGTDFTLTISSLQPEDFATYFCQQGNTFPPTFGQGTKLEIK

SEQ ID NO: 993 - protein, 107 aa, Artificial Sequence
  Description of Artificial Sequence: Synthetic polypeptide
DIQMTQSPSSLSASVGDRVTITCRASQDISNFLNWYQQKPGKAPKLLIYYTSRLQSGVPSRFSGSGSGTDYTLTISSLQPEDFATYFCQQGNTRPPTFGQGTKLEIK

SEQ ID NO: 994 - protein, 107 aa, Artificial Sequence
  Description of Artificial Sequence: Synthetic polypeptide
DIQMTQSPSSLSASVGDRVTITCRASQDINNYLNWYQQKPGKAPKLLIYYTSRLQSGVPSRFSGSGSGTDFTLTISSLQPEDFATYFCQQGNTQPPTFGQGTKLEIK

SEQ ID NO: 995 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYASGLQSGVPSRFSGSGSGTDYTLTISSLQPEDFATYFCQQGNTWPPTFGQGTKLEIK

SEQ ID NO: 996 - protein, 107 aa, Artificial Sequence
  Description of Artificial Sequence: Synthetic polypeptide
DIQMTQSPSSLSASVGDRVTITCRASQDISRYLNWYQQKPGKAPKLLIYYTSRLQSGVPSRFSGSGSGTDFTLTISSLQPEDFATYYCQQGNTQPPTFGQGTKLEIK

SEQ ID NO: 997 - protein, 107 aa, Artificial Sequence
  Description of Artificial Sequence: Synthetic polypeptide
DIQMTQSPSSLSASVGDRVTITCRASQDIATYLNWYQQKPGKAPKLLIYYTSRLQSGVPSRFSGSGSGTDFTLTISSLQPEDFATYFCQQGNTMPPTFGQGTKLEIK

SEQ ID NO: 998 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTFPPTFGQGTKLEIK

SEQ ID NO: 999 - protein, 107 aa, Artificial Sequence
  Description of Artificial Sequence: Synthetic polypeptide
DIQMTQSPSSLSASVGDRVTITCRASQRIGNYLNWYQQKPGKTVKLLIYYASRLQSGVPSRFSGSGSGTDFTLTISSLQPEDFATYFCQQGNTLPPTFGQGTKLEIK

SEQ ID NO: 1000 - protein, 107 aa, Artificial Sequence
  Description of Artificial Sequence: Synthetic polypeptide
DIQMTQSPSSLSASVGDRVTITCRASQEISNYLNWYQQKPGKAPKLLIYYTSRLQSGVPSRFSGSGSGTDYTLTISSLQPEDFATYYCQQGNSQPPTFGQGTKLEIK

SEQ ID NO: 1001 - protein, 107 aa, Artificial Sequence
  Description of Artificial Sequence: Synthetic polypeptide
DIQMTQSPSSLSASVGDRVTITCRASQDIANYLNWYQQKPGKAPKLLIYYTSRLQSGVPSRFSGSGSGTDFTLTISSLQPEDFATYYCQQGNTLPPTFGQGTKLEIK

SEQ ID NO: 1002 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYASRLQSGVPSRFSGSGSGTDYTLTISSLQPEDFATYFCQQGNTFPPTFGQGTKLEIK

SEQ ID NO: 1003 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYYCQQGNTQPPTFGQGTKLEIK

SEQ ID NO: 1004 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTPPPTFGQGTKLEIK

SEQ ID NO: 1005 - protein, 107 aa, Artificial Sequence
  Description of Artificial Sequence: Synthetic polypeptide
DIQMTQSPSSLSASVGDRVTITCRASQDISNFLNWYQQKPGKAPKLLIYYTSRLQSGVPSRFSGSGSGTDYTLTISSLQPEDFATYYCQQGNTLPPTFGQGTKLEIK

SEQ ID NO: 1006 - protein, 107 aa, Artificial Sequence
  Description of Artificial Sequence: Synthetic polypeptide
DIQMTQSPSSLSASVGDRVTITCRASQDIGNFLNWYQQKPGKAPKLLIYYTSRLQSGVPSRFSGSGSGTDYTLTISSLQPEDFATYFCQQGNTRPPTFGQGTKLEIK

SEQ ID NO: 1007 - protein, 107 aa, Artificial Sequence
  Description of Artificial Sequence: Synthetic polypeptide
DIQMTQSPSSLSASVGDRVTITCRASQDITNYLNWYQQKPGKAPKLLIYYTSRLQSGVPSRFSGSGSGTDYTLTISSLQPEDFATYYCQQGNTPPPTFGQGTKLEIK

SEQ ID NO: 1008 - protein, 107 aa, Artificial Sequence
  Description of Artificial Sequence: Synthetic polypeptide
DIQMTQSPSSLSASVGDRVTITCRASQDISDYLNWYQQKPGKAPKLLIYYTSRLQSGVPSRFSGSGSGTDYTLTISSLQPEDFATYFCQQGNMWPPTFGQGTKLEIK

SEQ ID NO: 1009 - protein, 107 aa, Artificial Sequence
  Description of Artificial Sequence: Synthetic polypeptide
DIQMTQSPSSLSASVGDRVTITCRASQDISSYLNWYQQKPGKAPKLLIYYASRLQSGVPSRFSGSGSGTDFTLTISSLQPEDFATYFCQQGNTMPPTFGQGTKLEIK

SEQ ID NO: 1010 - protein, 107 aa, Artificial Sequence
  Description of Artificial Sequence: Synthetic polypeptide
DIQMTQSPSSLSASVGDRVTITCRASQDISHYLNWYQQKPGKAPKLLIYYTSRLQSGVPSRFSGSGSGTDFTLTISSLQPEDFATYYCQQGNTLPPTFGQGTKLEIK

SEQ ID NO: 1011 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYASRLQSGVPSRFSGSGSGTDFTLTISSLQPEDFATYFCQQGNTMPPTFGQGTKLEIK

SEQ ID NO: 1012 - protein, 107 aa, Artificial Sequence
  Description of Artificial Sequence: Synthetic polypeptide
DIQMTQSPSSLSASVGDRVTITCRASQDISQYLNWYQQKPGKAPKLLIYYTSRLQSGVPSRFSGSGSGTDFTLTISSLQPEDFATYFCQQGNTRPPTFGQGTKLEIK

SEQ ID NO: 1013 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNMRPPTFGQGTKLEIK

SEQ ID NO: 1014 - protein, 107 aa, Artificial Sequence
  Description of Artificial Sequence: Synthetic polypeptide
DIQMTQSPSSLSASVGDRVTITCRASQDISTYLNWYQQKPGKAPKLLIYYASRLQSGVPSRFSGSGSGTDFTLTISSLQPEDFATYFCQQGNTLPPTFGQGTKLEIK

SEQ ID NO: 1015 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTGPPTFGQGTKLEIK

SEQ ID NO: 1016 - protein, 107 aa, Artificial Sequence
  Description of Artificial Sequence: Synthetic polypeptide
DIQMTQSPSSLSASVGDRVTITCRASQNINNYLNWYQQKPGKAPKLLIYYTSRLQSGVPSRFSGSGSGTDYTLTISSLQPEDFATYFCQQGNTMPPTFGQGTKLEIK

SEQ ID NO: 1017 - protein, 107 aa, Artificial Sequence
  Description of Artificial Sequence: Synthetic polypeptide
DIQMTQSPSSLSASVGDRVTITCRASQDISKYLNWYQQKPGKAPKLLIYYTSRLQSGVPSRFSGSGSGTDYTLTISSLQPEDFATYYCQQGNTPPPTFGQGTKLEIK

SEQ ID NO: 1018 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYYCQQGNTVPPTFGQGTKLEIK

SEQ ID NO: 1019 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSKLQSGVPSRFSGSGSGTDYTLTISSLQPEDFATYFCQQGNIFPPTFGQGTKLEIK

SEQ ID NO: 1020 - protein, 107 aa, Artificial Sequence
  Description of Artificial Sequence: Synthetic polypeptide
DIQMTQSPSSLSASVGDRVTITCRASQGIYNYLNWYQQKPGKAPKLLIYYTSRLQSGVPSRFSGSGSGTDYTLTISSLQPEDFATYFCQQGNTLPPTFGQGTKLEIK

SEQ ID NO: 1021 - protein, 107 aa, Artificial Sequence
  Description of Artificial Sequence: Synthetic polypeptide
DIQMTQSPSSLSASVGDRVTITCRASQDISSYLNWYQQKPGKAPKLLIYYTSRLQSGVPSRFSGSGSGTDFTLTISSLQPEDFATYYCQQGNTLPPTFGQGTKLEIK

SEQ ID NO: 1022 - protein, 107 aa, Artificial Sequence
  Description of Artificial Sequence: Synthetic polypeptide
DIQMTQSPSSLSASVGDRVTITCRASQEISNYLNWYQQKPGKAPKLLIYYTSRLQSGVPSRFSGSGSGTDYTLTISSLQPEDFATYFCQQGNTGPPTFGQGTKLEIK

SEQ ID NO: 1023 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYYCQQGNTPPPTFGQGTKLEIK

SEQ ID NO: 1024 - protein, 107 aa, Artificial Sequence
  Description of Artificial Sequence: Synthetic polypeptide
DIQMTQSPSSLSASVGDRVTITCRASQDISDYLNWYQQKPGKAPKLLIYYTSRLQSGVPSRFSGSGSGTDYTLTISSLQPEDFATYYCQQGNTWPPTFGQGTKLEIK

SEQ ID NO: 1025 - protein, 107 aa, Artificial Sequence
  Description of Artificial Sequence: Synthetic polypeptide
DIQMTQSPSSLSASVGDRVTITCRASQDIWKYLNWYQQKPGKAPKLLIYYASRLQSGVPSRFSGSGSGTDFTLTISSLQPEDFATYYCQQGNTLPPTFGQGTKLEIK

SEQ ID NO: 1026 - protein, 107 aa, Artificial Sequence
  Description of Artificial Sequence: Synthetic polypeptide
DIQMTQSPSSLSASVGDRVTITCRASQDISTYLNWYQQKPGKAPKLLIYYTSRLQSGVPSRFSGSGSGTDYTLTISSLQPEDFATYYCQQGNTWPPTFGQGTKLEIK

SEQ ID NO: 1027 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYYCQQGNTPPPTFGQGTKLEIK

SEQ ID NO: 1028 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYFCQQGNAPPPTFGQGTKLEIK

SEQ ID NO: 1029 - protein, 107 aa, Artificial Sequence
  Description of Artificial Sequence: Synthetic polypeptide
DIQMTQSPSSLSASVGDRVTITCRASQDIYKFLNWYQQKPGKAPKLLIYYTSRLQSGVPSRFSGSGSGTDYTLTISSLQPEDFATYFCQQGNTLPPTFGQGTKLEIK

SEQ ID NO: 1030 - protein, 107 aa, Artificial Sequence
  Description of Artificial Sequence: Synthetic polypeptide
DIQMTQSPSSLSASVGDRVTITCRASQDIFNYLNWYQQKPGKAPKLLIYYTSRLQSGVPSRFSGSGSGTDYTLTISSLQPEDFATYFCQQGNTLPPTFGQGTKLEIK

SEQ ID NO: 1031 - protein, 107 aa, Artificial Sequence
  Description of Artificial Sequence: Synthetic polypeptide
DIQMTQSPSSLSASVGDRVTITCRASQDISNTLNWYQQKPGKAPKLLIYYASRLQSGVPSRFSGSGSGTDFTLTISSLQPEDFATYFCQQGNTLPPTFGQGTKLEIK

SEQ ID NO: 1032 - protein, 107 aa, Artificial Sequence
  Description of Artificial Sequence: Synthetic polypeptide
DIQMTQSPSSLSASVGDRVTITCRASQHISNYLNWYQQKPGKAPKLLIYYTSRLQSGVPSRFSGSGSGTDYTLTISSLQPEDFATYFCQQGNTQPPTFGQGTKLEIK

SEQ ID NO: 1033 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNMPPPTFGQGTKLEIK

SEQ ID NO: 1034 - protein, 107 aa, Artificial Sequence
  Description of Artificial Sequence: Synthetic polypeptide
DIQMTQSPSSLSASVGDRVTITCRASQDITNYLNWYQQKPGKAPKLLIYYTSRLQSGVPSRFSGSGSGTDFTLTISSLQPEDFATYFCQQGNTVPPTFGQGTKLEIK

SEQ ID NO: 1035 - protein, 107 aa, Artificial Sequence
  Description of Artificial Sequence: Synthetic polypeptide
DIQMTQSPSSLSASVGDRVTITCRASQDISNYLNWYQQKPGKAPKLLIYFTSRLQSGVPSRFSGSGSGTDFTLTISSLQPEDFATYYCQQGNTQPPTFGQGTKLEIK

SEQ ID NO: 1036 - protein, 107 aa, Artificial Sequence
  Description of Artificial Sequence: Synthetic polypeptide
DIQMTQSPSSLSASVGDRVTITCRASQDISKFLNWYQQKPGKAPKLLIYYTSRLQSGVPSRFSGSGSGTDYTLTISSLQPEDFATYYCQQGNTRPPTFGQGTKLEIK

SEQ ID NO: 1037 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYFCQQGNTFPPTFGQGTKLEIK

SEQ ID NO: 1038 - protein, 107 aa, Artificial Sequence
  Description of Artificial Sequence: Synthetic polypeptide
DIQMTQSPSSLSASVGDRVTITCRASQDIYNVLNWYQQKPGKAPKLLIYYASRLQSGVPSRFSGSGSGTDFTLTISSLQPEDFATYFCQQGITLPPTFGQGTKLEIK

SEQ ID NO: 1039 - protein, 107 aa, Artificial Sequence
  Description of Artificial Sequence: Synthetic polypeptide
DIQMTQSPSSLSASVGDRVTITCRASQHISNYLNWYQQKPGKAPKLLIYYTSRLQSGVPSRFSGSGSGTDYTLTISSLQPEDFATYFCQQGNTWPPTFGQGTKLEIK

SEQ ID NO: 1040 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTQPSTFGQGTKLEIK

SEQ ID NO: 1041 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDFTLTISSLQPEDFATYFCQQGNTQPPTFGQGTKLEIK

SEQ ID NO: 1042 - protein, 107 aa, Artificial Sequence; identical to SEQ ID NO: 85
  Description of Artificial Sequence: Synthetic polypeptide

SEQ ID NO: 1043 - protein, 107 aa, Artificial Sequence; identical to SEQ ID NO: 86
  Description of Artificial Sequence: Synthetic polypeptide

SEQ ID NO: 1044 - protein, 107 aa, Artificial Sequence; identical to SEQ ID NO: 88
  Description of Artificial Sequence: Synthetic polypeptide

SEQ ID NO: 1045 - protein, 107 aa, Artificial Sequence; identical to SEQ ID NO: 84
  Description of Artificial Sequence: Synthetic polypeptide

SEQ ID NO: 1046 - protein, 107 aa, Artificial Sequence; identical to SEQ ID NO: 89
  Description of Artificial Sequence: Synthetic polypeptide

SEQ ID NO: 1047 - protein, 107 aa, Artificial Sequence; identical to SEQ ID NO: 87
  Description of Artificial Sequence: Synthetic polypeptide

SEQ ID NO: 1048 - protein, 107 aa, Artificial Sequence
  Description of Artificial Sequence: Synthetic polypeptide
DIQMTQSPSSLSASVGDRVTITCRASQNIENFLNWYQQKPGKAPKLLIYYTSRLQSGVPSRFSGSGSGTDFTLTISSLQPEDFATYFCQQGNTWPPTFGQGTKLEIK

SEQ ID NO: 1049 - protein, 107 aa, Artificial Sequence
  Description of Artificial Sequence: Synthetic polypeptide
DIQMTQSPSSLSASVGDRVTITCRASQDIYNYLNWYQQKPGKAPKLLIYYTSRLQSGVPSRFSGSGSGTDYTLTISSLQPEDFATYFCQQGNTPPPTFGQGTKLEIK

SEQ ID NO: 1050 - protein, 107 aa, Artificial Sequence
  Description of Artificial Sequence: Synthetic polypeptide
DIQMTQSPSSLSASVGDRVTITCRASQDIASYLNWYQQKPGKAPKLLIYYTSRLQSGVPSRFSGSGSGTDFTLTISSLQPEDFATYFCQQGNTQPPTFGQGTKLEIK

SEQ ID NO: 1051 - protein, 107 aa, Artificial Sequence
  Description of Artificial Sequence: Synthetic polypeptide
DIQMTQSPSSLSASVGDRVTITCRASQDISNYLNWYQQKPGKVPKLLIYYTSRLQSGVPSRFSGSGSGTDYTLTISSLQPEDFATYFCQQGNTQPPTFGQGTKLEIK

SEQ ID NO: 1052 - protein, 107 aa, Artificial Sequence; identical to SEQ ID NO: 92
  Description of Artificial Sequence: Synthetic polypeptide

SEQ ID NO: 1053 - protein, 124 aa, Artificial Sequence; identical to SEQ ID NO: 74
  Description of Artificial Sequence: Synthetic polypeptide

SEQ ID NO: 1054 - protein, 124 aa, Artificial Sequence; identical to SEQ ID NO: 75
  Description of Artificial Sequence: Synthetic polypeptide

SEQ ID NO: 1055 - protein, 124 aa, Artificial Sequence; identical to SEQ ID NO: 76
  Description of Artificial Sequence: Synthetic polypeptide

SEQ ID NO: 1056 - protein, 124 aa, Artificial Sequence; identical to SEQ ID NO: 77
  Description of Artificial Sequence: Synthetic polypeptide

SEQ ID NO: 1057 - protein, 124 aa, Artificial Sequence; identical to SEQ ID NO: 78
  Description of Artificial Sequence: Synthetic polypeptide

SEQ ID NO: 1058 - protein, 124 aa, Artificial Sequence; identical to SEQ ID NO: 79
  Description of Artificial Sequence: Synthetic polypeptide

SEQ ID NO: 1059 - protein, 124 aa, Artificial Sequence; identical to SEQ ID NO: 80
  Description of Artificial Sequence: Synthetic polypeptide

SEQ ID NO: 1060 - protein, 124 aa, Artificial Sequence; identical to SEQ ID NO: 74
  Description of Artificial Sequence: Synthetic polypeptide

SEQ ID NO: 1061 - protein, 124 aa, Artificial Sequence; identical to SEQ ID NO: 82
  Description of Artificial Sequence: Synthetic polypeptide

SEQ ID NO: 1062 - protein, 124 aa, Artificial Sequence; identical to SEQ ID NO: 83
  Description of Artificial Sequence: Synthetic polypeptide

SEQ ID NO: 1063 - protein, 107 aa, Artificial Sequence; identical to SEQ ID NO: 84
  Description of Artificial Sequence: Synthetic polypeptide

SEQ ID NO: 1064 - protein, 107 aa, Artificial Sequence; identical to SEQ ID NO: 85
  Description of Artificial Sequence: Synthetic polypeptide

SEQ ID NO: 1065 - protein, 107 aa, Artificial Sequence; identical to SEQ ID NO: 86
  Description of Artificial Sequence: Synthetic polypeptide

SEQ ID NO: 1066 - protein, 107 aa, Artificial Sequence; identical to SEQ ID NO: 87
  Description of Artificial Sequence: Synthetic polypeptide

SEQ ID NO: 1067 - protein, 107 aa, Artificial Sequence; identical to SEQ ID NO: 88
  Description of Artificial Sequence: Synthetic polypeptide

SEQ ID NO: 1068 - protein, 107 aa, Artificial Sequence; identical to SEQ ID NO: 89
  Description of Artificial Sequence: Synthetic polypeptide

SEQ ID NO: 1069 - protein, 107 aa, Artificial Sequence; identical to SEQ ID NO: 88
  Description of Artificial Sequence: Synthetic polypeptide

SEQ ID NO: 1070 - protein, 107 aa, Artificial Sequence; identical to SEQ ID NO: 84
  Description of Artificial Sequence: Synthetic polypeptide

SEQ ID NO: 1071 - protein, 107 aa, Artificial Sequence; identical to SEQ ID NO: 92
  Description of Artificial Sequence: Synthetic polypeptide

SEQ ID NO: 1072 - protein, 107 aa, Artificial Sequence; identical to SEQ ID NO: 93
  Description of Artificial Sequence: Synthetic polypeptide

SEQ ID NO: 1073 - protein, 120 aa, Artificial Sequence
  Description of Artificial Sequence: Synthetic polypeptide
  MOD_RES (18)..(18): Ala or Val
  MOD_RES (30)..(30): Ser, Asn, Thr, Gly or Ala
  MOD_RES (31)..(31): Ser, Trp, Tyr, Ile, Asn, Phe, Arg or Leu
  MOD_RES (33)..(33): Ala, Thr, Ser, Pro or Gly
  MOD_RES (34)..(34): Ile, Thr or Val
  MOD_RES (35)..(35): Ser or Thr
  MOD_RES (50)..(50): Gly or Trp
  MOD_RES (51)..(51): Ile, Thr, Met, Leu, Val or Asn
  MOD_RES (55)..(55): Leu, Phe, Thr or Ile
  MOD_RES (56)..(56): Gly, Arg or Asp
  MOD_RES (57)..(57): Thr, Ser, Ala, Asn, Pro, Ile, Val, Lys or Phe
  MOD_RES (58)..(58): Ala, Pro, Ser or Gly
  MOD_RES (59)..(59): Asn, Ile, Thr, Ser, Val, His, Ala, Arg, Met or Leu
  MOD_RES (65)..(65): Leu or Gln
  MOD_RES (79)..(79): Val or Ala
  MOD_RES (99)..(99): Gly, Ser, Trp, Thr or Ala
  MOD_RES (100)..(100): Leu, Val, Ile, Phe, Arg or Gln
  MOD_RES (101)..(101): Tyr, Phe, Val, Pro or His
  MOD_RES (102)..(102): Tyr, Phe or Val
  MOD_RES (103)..(103): Asp, Asn, Glu, Thr, Ile or Ala
  MOD_RES (104)..(104): Pro, Thr, Phe, Arg, Gly or Asp
  MOD_RES (105)..(105): Thr, Ser, Ala, Lys, Arg, Ile, Tyr, Val, Pro, Asn or Gly
  MOD_RES (106)..(106): Arg, Trp, Ser, Pro or Ala
  MOD_RES (107)..(107): Ala, Phe or Met
EVQLVQSGAEVKKPGSSXKVSCKASGGTFXXYXXXWVRQAPGQGLEWMGXXIPIXXXXXYAQKFXGRVTITADESTSTXYMELSSLRSEDTAVYYCARXXXXXXXXXDYWGQGTLVTVSS

SEQ ID NO: 1074 - protein, 108 aa, Artificial Sequence
  Description of Artificial Sequence: Synthetic polypeptide
  MOD_RES (1)..(1): Asp or Glu
  MOD_RES (4)..(4): Met or Leu
  MOD_RES (11)..(11): His or Gln
  MOD_RES (28)..(28): Ser, Arg, Thr, Asn, Ile, Cys, Gly, Lys, Tyr or Trp
  MOD_RES (31)..(31): Ser, Arg, Thr, Gly, Asn, Lys, Cys, His, Val, Pro or Leu
  MOD_RES (32)..(32): Ser, Arg, Thr, Asn, Cys, Gly, Ile, Lys, Met, Leu, Tyr, Pro or Val
  MOD_RES (49)..(49): Arg or Lys
  MOD_RES (50)..(50): His or Tyr
  MOD_RES (51)..(51): Ala, Val, Pro, Thr, Gly, Ser, Glu or Asp
  MOD_RES (55)..(55): Ile, Leu, Val, Thr, Ser, Met, Asn, Lys, Phe or Arg
  MOD_RES (76)..(76): His or Asn
  MOD_RES (91)..(91): Ser, Arg, Asn, Gly, Thr, Cys or Ile
  MOD_RES (92)..(92): Ser, Arg, Gly, Ile, Cys, Asn, Thr or Met
  MOD_RES (93)..(93): Ser, Arg, Ile, Cys, Gly, Asn, Thr  or Lys
  MOD_RES (94)..(94): Ser or Leu
  MOD_RES (96)..(96): Pro, Leu, Ala, Ser, Arg, Thr, Gln or His
  MOD_RES (97)..(97): Pro, Ser, Arg, Leu, Thr, Ala, Gln, His, Val or Met
  MOD_RES (104)..(104): Gln or Lys
XIVXTQSPDFXSVTPKEKVTITCRASQXIGXXLHWYQQKPDQSPKLLIXXXSQSXSGVPSRFSGSGSGTDFTLTIXSLEAEDAATYYCHQXXXXPXXTFGQGTXVEIK

SEQ ID NO: 1075 - protein, 117 aa, Artificial Sequence
  Description of Artificial Sequence: Synthetic polypeptide
  MOD_RES (31)..(31): Asp, Asn, His, Tyr or Ile
  MOD_RES (32)..(32): Tyr, Phe, Leu, Ser or Arg
  MOD_RES (33)..(33): Gly, Ser or Asn
  MOD_RES (35)..(35): Asn, Thr, Ser, His, Gln or Tyr
  MOD_RES (50)..(50): Met, Ile, Val, Leu, Arg, Lys or Ser
  MOD_RES (52)..(52): Trp, Arg, Gly, Ser, Ala or Leu
  MOD_RES (53)..(53): Gly, Ala, Ser, Asp, Glu, Val or Asn
  MOD_RES (54)..(54): Asp, Gly, Glu, Ala, Val, Gly or Tyr
  MOD_RES (56)..(56): Ser, Thr, Phe, Ala, Tyr or Trp
  MOD_RES (58)..(58): Asp, Ala, His, Val, Ser, Asn or Gly
  MOD_RES (60)..(60): Asp or Ala
  MOD_RES (61)..(61): Ser or Asp
  MOD_RES (62)..(62): Thr or Ser
  MOD_RES (63)..(63): Leu or Val
  MOD_RES (65)..(65): Ser or Gly
  MOD_RES (98)..(98): Glu, His, Gln, Leu, Tyr, Asp, Asn, Thr, Pro, Ala, Ser or Arg
  MOD_RES (99)..(99): Trp, Ser, Leu, Cys, Arg, Phe, Asp, Tyr, Pro, Ile or Gly
  MOD_RES (100)..(100): His, Gln, Arg, Leu, Tyr, Pro, Ala, Val, Asp or Cys
  MOD_RES (101)..(101): His, Gln, Pro, Leu, Asn, Tyr, Arg, Thr, Asp, Ala or Cys
  MOD_RES (102)..(102): Gly, Arg, Ala, Val, Trp, Glu, Ser, Pro or Ile
  MOD_RES (103)..(103): Pro, Thr, Ser, Gln, Ala or Lys
  MOD_RES (104)..(104): Val, Leu, Gly, Asp, Glu, Trp, Arg, Pro, Ala or Ile
  MOD_RES (105)..(105): Ala, Asp, Val, Gly or Thr
  MOD_RES (106)..(106): Tyr, Ser, Phe, Cys, Asn, Pro, Ile or His
EVQLVESGGGLVQPGGSLRLSCAASGFTFSXXXVXWVRQAPGKGLEWVSXIXXXGXTXYXXXXKXRFTISRDNSKNTLYLQMNSLRAEDTAVYYCARXXXXXXXXXWGQGTLVTVSS

SEQ ID NO: 1076 - protein, 107 aa, Artificial Sequence
  Description of Artificial Sequence: Synthetic polypeptide
  MOD_RES (24)..(24): Lys or Arg
  MOD_RES (28)..(28): Ala, Ser, Val, Gly, Asp, Thr or Pro
  MOD_RES (30)..(30): Ser, Arg, Thr, Ile, Asn, Cys or Lys
  MOD_RES (31)..(31): Ser, Arg, Asn, Gly, Cys, Thr or Ile
  MOD_RES (32)..(32): Ala, Pro, Thr, Gly, Val, Ser or Arg
  MOD_RES (33)..(33): Val or Leu
  MOD_RES (50)..(50): Trp, Ser, Arg, Leu, Cys, Gln or Gly
  MOD_RES (53)..(53): Thr, Ser, Ile, Leu, Lys, Ala or Arg
  MOD_RES (54)..(54): Arg or Leu
  MOD_RES (55)..(55): His, Gln, Thr, Ala, Glu or Phe
  MOD_RES (56)..(56): Thr or Ser
  MOD_RES (91)..(91): His or Ser
  MOD_RES (92)..(92): Tyr, Asn, Phe, Asp, Gly or His
  MOD_RES (93)..(93): Ser, Arg, Gly, Thr, Ile or Cys
  MOD_RES (94)..(94): Thr, Ser, Pro, Met, Ile or Ala
  MOD_RES (95)..(95): Pro, Thr, Arg, Leu, Gln, Ala or Ser
  MOD_RES (96)..(96): Phe or Tyr
DIQMTQSPSSLSASVGDRVTITCXASQXVXXXXAWYQQKPGKAPKLLIYXASXXXXGVPSRFSGSGSGTDFTLTISSLQPEDFATYYCQQXXXXXXTFGQGTKLEIK

SEQ ID NO: 1077 - protein, 124 aa, Artificial Sequence
  Description of Artificial Sequence: Synthetic polypeptide
  MOD_RES (2)..(2): Ile or Val
  MOD_RES (30)..(30): Thr, Asn, Ala, Ser, Arg, Asp, Lys, Pro, Gln, Met, Gly or Glu
  MOD_RES (31)..(31): Asn, Asp, His, Thr, Ser, Gln or Lys
  MOD_RES (34)..(34): Met or Ile
  MOD_RES (35)..(35): Asn, Ile, Thr, Gln, Ser, Gly, Ala or Val
  MOD_RES (55)..(55): Thr, Asn or Ser
  MOD_RES (57)..(57): Glu, Lys, Val, Gln, Arg, Leu, Ser, Asn, Ile, Asp or Ala
  MOD_RES (59)..(59): Thr, Ser, His, Asn, Met, Lys, Ala, Arg, Gln or Asp
  MOD_RES (62)..(62): Asp or Gln
  MOD_RES (63)..(63): Asp, Gly or Lys
  MOD_RES (64)..(64): Phe or Leu
  MOD_RES (65)..(65): Lys, Thr or Gln
  MOD_RES (68)..(68): Phe or Val
  MOD_RES (70)..(70): Phe or Met
  MOD_RES (72)..(72): Leu or Thr
  MOD_RES (95)..(95): Phe or Tyr
  MOD_RES (99)..(99): Lys, Arg or Asn
  MOD_RES (100)..(100): Phe, Leu, Tyr, Ile, Val or Cys
  MOD_RES (101)..(101): Leu, Phe, Met, Arg, Ser, Trp, Gln, Val, Asn, Gly or Cys
  MOD_RES (102)..(102): Thr, Asn, Lys, Ser, Arg, Leu, Pro, Phe, Asp, Met or Ala
  MOD_RES (103)..(103): Thr, Pro, Val, Ser or Ala
  MOD_RES (104)..(104): Val, Met, Glu, Ala, Arg, Ile, Gln, Gly or Asp
  MOD_RES (105)..(105): Val, Asp, Ala, Glu, Ser, Met, Ile or Pro
  MOD_RES (106)..(106): Val, Ala, Glu, Met, Asp, Gly, Ile, Gln, Pro, Asn, Leu or His
  MOD_RES (107)..(107): Thr, Ser, Met or Asn
  MOD_RES (108)..(108): Asp or Glu
  MOD_RES (109)..(109): Tyr, Asn, Ser, Cys, His, Asp, Ile, Phe, Val, Leu or Ala
  MOD_RES (110)..(110): Ala, Thr, Arg or Cys
EXQLVQSGAEVKKPGASVKVSCKASGYTFXXYGXXWVRQAPGQGLEWMGWINTYXGXPXYAXXXXGRXTXTXDTSTSTAYMELSSLRSEDTAVYXCARXXXXXXXXXXXXMDYWGQGTTVTVSS

SEQ ID NO: 1078 - protein, 107 aa, Artificial Sequence
  Description of Artificial Sequence: Synthetic polypeptide
  MOD_RES (28)..(28): Asp, Asn, Glu, His, Gly, Val, Arg or Ala
  MOD_RES (30)..(30): Ser, Tyr, Glu, Ala, Thr, Trp, Gly, Asn, Phe or Cys
  MOD_RES (31)..(31): Asn, Gln, Ser, Lys, Thr, His, Asp or Arg
  MOD_RES (32)..(32): Tyr, Val, Phe or Thr
  MOD_RES (43)..(43): Thr, Ala or Val
  MOD_RES (44)..(44): Val or Pro
  MOD_RES (50)..(50): Tyr, Phe or Asn
  MOD_RES (51)..(51): Thr or Ala
  MOD_RES (53)..(53): Arg, Leu, Lys or Gly
  MOD_RES (71)..(71): Tyr or Phe
  MOD_RES (87)..(87): Phe or Tyr
  MOD_RES (92)..(92): Asn or Ile
  MOD_RES (93)..(93): Thr, Ser, Met, Ile, Ala or Arg
  MOD_RES (94)..(94): Leu, Trp, Gln, Pro, Met, Arg, Phe, Gly, Val, Tyr or Ala
  MOD_RES (96)..(96): Pro, Thr, Ser or Ala
DIQMTQSPSSLSASVGDRVTITCRASQXIXXXLNWYQQKPGKXXKLLIYXXSXLQSGVPSRFSGSGSGTDXTLTISSLQPEDFATYXCQQGXXXPXTFGQGTKLEIK

SEQ ID NO: 1079 - protein, 5 aa, Artificial Sequence
  Description of Artificial Sequence: Synthetic peptide
NYGMN

SEQ ID NO: 1080 - protein, 17 aa, Artificial Sequence
  Description of Artificial Sequence: Synthetic peptide
WINTYTGEPTYADDFKG

SEQ ID NO: 1081 - protein, 15 aa, Artificial Sequence
  Description of Artificial Sequence: Synthetic peptide
KFLTTVVVTDYAMDY

SEQ ID NO: 1082 - protein, 11 aa, Artificial Sequence
  Description of Artificial Sequence: Synthetic peptide
RASQDISNYLN

SEQ ID NO: 1083 - protein, 7 aa, Artificial Sequence
  Description of Artificial Sequence: Synthetic peptide
YTSRLQS

SEQ ID NO: 1084 - protein, 9 aa, Artificial Sequence
  Description of Artificial Sequence: Synthetic peptide
QQGNTLPPT

We claim:

1. A binding protein that binds human TNF-α, the binding protein comprising at least one heavy chain variable region (VH region) and at least one light chain variable region (VL region), wherein the VH region comprises the amino acid sequence of SEQ ID NO: 74 and the VL region comprises the amino acid sequence of SEQ ID NO: 84.

2. The binding protein of claim 1, wherein the binding protein comprises two VH regions and two VL regions.

3. The binding protein of claim 1, wherein the binding protein comprises:
   (a) a heavy chain constant region comprising an amino acid sequence of SEQ ID NO:2 or SEQ ID NO: 3; and
   (b) a light chain constant region comprising an amino acid sequence of SEQ ID NO:4 or SEQ ID NO: 5.

4. The binding protein of claim 1, wherein the binding protein comprises a DVD-Ig protein.

5. The binding protein of claim 2, wherein the binding protein is conjugated to an imaging agent selected from the group consisting of a radiolabel, an enzyme, a fluorescent label, a luminescent label, a bioluminescent label, a magnetic label, and biotin.

6. The binding protein of claim 1, wherein the binding protein further comprises a therapeutic or cytotoxic agent selected from the group consisting of an antimetabolite, an alkylating agent, an antibiotic, a growth factor, a cytokine, an anti-angiogenic agent, an anti-mitotic agent, and an anthracycline.

7. A pharmaceutical composition comprising the binding protein of claim 1, and a pharmaceutically acceptable carrier.

8. A pharmaceutical composition comprising the binding protein of claim 2, and a pharmaceutically acceptable carrier.

9. A pharmaceutical composition comprising the binding protein of claim 4, and a pharmaceutically acceptable carrier.

10. The binding protein of claim 1, wherein the binding protein comprises a bispecific antibody.

11. A pharmaceutical composition comprising the binding protein of claim 10, and a pharmaceutically acceptable carrier.

12. The binding protein of claim 1, wherein the binding protein is conjugated to an imaging agent selected from the group consisting of a radiolabel, an enzyme, a fluorescent label, a luminescent label, a bioluminescent label, a magnetic label, and biotin.

* * * * *